United States Patent 11,602,550 (COMPOSITIONS COMPRISING BACTERIAL STRAINS AND USE THEREOF IN CONTROLLING PATHOGENIC MICROORGANISMS) - sequence listing, part 4

SEQ ID NO: 6 - DNA, 4096210 bp, Bacillus subtilis (residues 2,048,106-4,096,210 of 4,096,210)
aggtcgttcacctgctggcggaggtcagtctacacaccttccattgaaagtgaatcctgcaggggttattccggtaatctttgcggttgcgtttttgataacgccgcggacgatcgcgtcattctttggaacaaacgatgtgacaaagtggattcaaaacaactttgataatacgcatccggtgggtatggcgatatatgttgcgttgattattgcctttacgtacttttatgcttttgtacaggtaaaccctgaacaaatggctgataaccttaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacaaattggcggaacatctttgttaattgttgtcggggtagccttggagacaatgaaacaactagaaagccagttggtgaaacgaaactaccgtggatttatgaaaaactagaggaaatggatttatccattccctcttaataaagagaggacggggggaaatccgaatgaacttagtcttaatggggcttcctggtgccggtaaaggcacacagggcgaacgaattgttgaggattatgggattcctcatatctcaacaggagatatgttccgtgctgctatgaaagaagaaacaccactcggactcgaagcaaaatcttatattgataagggagagctcgtacctgacgaagtcacaatcggaattgtaaaagagagacttggcaaagatgattgtgaaagaggttttcttctggacggatttccgcgaacagtcgctcaagccgaagctcttgaagaaattcttgaggaatacggcaagccgattgattatgtcattaacattgaagtcgacaaagacgctcttatggaacgtctgactggacgcagaatttgcagtgtttgcggcacaacctatcatttagtctttaatccgccgaaaacgccgggtatttgtgataaagacggaggcgaactctatcaacgggcagatgataatgaggaaacagtctctaaacggcttgaggtaaacatgaagcaaactcagcctttactcgatttctattcagagaaaggttatcttgcaaacgtgaatggccagcaggacattcaagacgtttatgcagatgtgaaggatcttcttggaggattaaaaaaatgattatctgtaaaaccccacgtgaacttggtatcatgcgggaagcagggcgaatcgtggctttaactcatgaagagttaaaaaagcacattaaaccaggaatctcgacaaaagaattggatcaaattgccgaacgttttattaagaagcagggtgcaatcccatcttttaaggggtataatgggtttcgcgggagcatttgcgtatcagttaatgaagaactcgttcacggcatacctggcagcagggtgctgaaggacggtgacatcatcagtattgatatcggtgctaaattaaatggttatcatggtgactctgcatggacatatccggtaggaaacatcagcgatgatgacaaaaaacttctggaagtgacagaggagtctttatataaaggcttgcaggaagcaaaaccaggtgaacgtttgtcgaatatttcccacgcaatacaaacgtatgtcgaaaatgagcagttttcagttgttagggagtatgtcggacatggtgttggtcaagacttgcatgaggacccgcaaattcctcattacggtccgcccaacaaaggaccacggcttaaacctggcatggttctcgctattgaacctatggtgaacgctggcagccgctacgtgaaaacattggctgataactggacggttgtaacggtagatgggaaaaagtgtgctcattttgaacatacgattgcgattacggaaacgggttttgatatactgacgagagtctagatgatgaaaataattccgaagacagatgtttttcaagcttgatagggcagaaagcttgggtgaacattggcaagaccgaattcatcttgctgcttgtcgttggaattttaaccatcatcaatgtactaacagcagacggagaaaagcgtacatttcattctcctaagaaaaagaatatcaatcatttaaccctttatgattgcgtatctccggaagttcagaacagtataaacgaaacagggcgtgtgacaaacttcttttgaaatttgtcagaaagcaagttactgatttgaagaagggagaacacttgaatggcgaaagacgatgtaattgaagtggaaggtactatagtcgaaacactgccaaacgcgatgttcaaagttgaacttgaaaatggccacactgttttggctcatgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgaaaaatgtaaagttattcgcagaaaaggaaaagtaatggtgatctgtgaaaatccaaagcataaacaaaaacaaggataatttataaggaggtgcccagagaatggctcgtattgctggtgtagatatcccacgtgacaaacgtgttgttatttctttaacatacatcttcggaattggccgcacaacggctcagcaagttttaaaagaagctggagtttcagaagatactcgtgtgcgcgatcttactgaagaagaacttggtaaaatccgtgatattattgacaaactgaaagtagaaggtgaccttcgccgtgaagtttctcttaatatcaaacgtctgatcgaaatcggaagctaccgcggaatccgtcatcgcagaggattacctgttcgcggacaaaactctaaaaacaacgcgcgtactcgtaaaggtccgcgtcgtactgtagctaacaagaaaaaataagtaagggaggttcttaaacaatggctgctgctcgtaaatctaacacgcgtaaacgtcgcgtgaaaaagaatattgagtctggaattgctcatattcgttcaactttcaataacacgatcgttacgatcactgacactcatggtaatgctatttcttggtctagtgccggagctttaggattcagaggttctcgtaaatctactccttttgctgcgcaaatggctgcagaaacagctgctaaaggttcaatcgaacatggtcttaaaactctagaggttactgttaaaggacctggttcaggccgtgaagctgcaatccgtgcacttcaagctgctggactagaagtcactgctatcagagacgtaactcctgttcctcataacggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccacttgagcgtggatatggtacaactctgggtaactccttacgtcgtatcctcttatcctcactccctggtgccgctgtaacatcaatccagatagatggtgtactgcacgaattctcgacaattgaaggcgttgtggaagatgttacaacgattatcttacacattaaaaagcttgcattgaaaatctactctgatgaagagaagacgctagaaattgatgtacagggtgaaggaactgtaacggcagctgatattacacacgatagtgatgtagagatcttaaatcctgatcttcatatcgcgactcttggtgagaatgcgagtttccgagttcgccttactgctcaaagaggacgtgggtatacgcctgctgacgcaaacaagagagacgatcagccaatcggcgtgattccgatcgattctatctatacgccagtttctcgtgtatcttatcaggtagagaacactcgtgtaggccaagttgcaaactatgataaacttacacttgatgtttggactgatggaagcactggaccgaaagaagcaattgcgcttggttcaaagattttaactgaacaccttaatatattcgttggtttaactgacgaagctcaacatgctgaaatcatggttgaaaaagaagaagatcaaaaagagaaagttcttgaaatgacaattgaagaattggatctttctgttcgttcttacaactgcttaaagcgtgcgggtattaacacggttcaagagcttgcgaacaagacggaagaagatatgatgaaagttcgaaatctaggacgcaaatcacttgaagaagtgaaagcgaaactagaagaacttggactcggacttcgcaaagacgattgactagtttcccttgtgaactaggattttcgtgtgtttattattcagaaacagcattccaataaaggaggggacatcacatgtcatacagaaaactaggacgtacgagtgcacagcgtaaagctatgcttcgtgatcttacaactgatttgatcatcaacgaaagaatcgaaacaactgaaacacgtgcgaaagaacttcgctctgtagttgaaaaaatgatcacgcttggcaaacgcggtgatcttcacgctcgccgtcaagctgctgcatacatccgcaacgaggttgcaaacgaagaaaataaccaagatgcacttcaaaaattattctctgacattgcaactcgttacgaggagcgccaaggcggatacacacgtattatgaagcttggtcctcgccgtggtgacggagcaccaatggcaattatcgaattggtttaatcacatatttttgtgtatctaaagaagggcgggacagtttctaactggatctatgccctttttttagatactgcaacttttaatatagagagaaaagcagagcattagctgagaggaggccggttttccatgaatcaaaatcagttgatatcggtagaggatatcgtatttcgatatcggaaggacgcagaaagacgagcactagacggcgtctccctgcaggtgtatgagggtgaatggcttgcaatcgtaggtcataacggttcagggaaatcaacactggcccgggcattgaatggtttaattcttcctgaatcaggcgacattgaggttgccgggattcaattaacagaggaatctgtttgggaagtgcgtaagaagataggtatggtctttcaaaatccggataaccaatttgtcggaacgactgttcgcgatgatgtggcttttggtttagaaaacaatggtgtaccgcgggaagaaatgattgagagagtagactgggcagtaaaacaggtgaatatgcaagattttctcgatcaagagccgcaccatctctccggaggccaaaagcagagagttgcgattgcgggggttattgccgcacgtcctgatattattatcttagatgaagcaacatccatgcttgatccgatcgggcgagaagaagtgcttgaaacggtaagacatttaaaagagcagggaatggcgactgtcatatccattacacatgatctggatgaggcagcaaaagcagacaggatcattgtcatgaatggcggtaaaaaatatgctgaagggccgcctaaagagatttttaaattgaataaagaacttgttcgaatcgggcttgatttacccttctcattccagcttagccagcttttaagagaaaatggactggctttggaagaaaaccatttgactcaggaagggctggtgaaagagctgtggacattacaatcaaagatgtagagcatcgctatcagatgaagacgccgtttgagcgcctagcactgtatgatatcaatgcatcgattaaagaaggaagctacgtagcagttatcgggcatacaggctctggcaagtccactcttcttcagcacctaaatggtctcctaaagccgacgaagggacagatatcactaggcagcactgtcattcaggcagggagaaagaataaagatctgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtcaccctttgaattaagcgggggacaaatgcgcagagttgcaattgccggcgtacttgcaatggaccctgaagtgcttgttctggatgaaccgactgcaggattggacccaagagggcgaaaagagattatggacatgttttatgagcttcatcaacgtgggaacttgacgacgatccttgtgacacacagcatggaggatgcagctgcatacgctgatgaaatgattgttatgcataaaggaacgatacaagcatcaggcagtccgcgtgatctgtttttaaagggtgaagagatggccggctgggggctggatcttcctgaaacaataaaattccaaagacaccttgaagctgcactgggtgtgagatttaatgagcctatgctcacaatcgaagatgccgctgccgaaatccgtgctctttttcagggagagaagactttatgatggacagcatgattatcggcaagtatgtaccggggacttcacttgtgcaccggcttgaccccagaacaaaactgatcacgatctttttatttgtctgcattgtattcttagccaataatgttcagacatatgcgttgcttggtttatttacaattggcgtcgtttctttaacaagagttcctttctcttttttaatgaaagggctgaagccaatcatctggattgtcctttttacgttccttcttcacattcttatgacacatgaaggaccgattatctttcaaataagttttttcaaagtctatgagggcggtctggttcaggggatattcatttctcttagattcgtctatttgattttaatcacaaccttattaacgcttacgactacaccgattgagattaccgatggaatggagcagctgctgaacccattgaaaaaattaaagcttcctgttcatgagctggctcttatgatgtcaatttctttacggtttattccgacactgatggaggagacagataagatcatgaaggctcagatggcgcgaggcgttgattttacaagcgggcctgtcaaagaaagagtgaaggctattgtcccgcttcttgtcccgctcttcgtcagcgcatttaaacgcgccgaagagcttgcggtggcaatggaagcaagaggctatcaaggcggagaaggacgtacgaaatatagaaagcttgtatggacaggaaaagacacttctgtcattgtcagcttaattgtattagctgctttgttatttttcttaagggcttagaggtgctgtatgagactgaaatgcacgatttcttatgacggacatttgtttaacggttatcaggttcagccgggcaaaagaacggttcaggatgaactggagaaagctttggctgtcctgcataagtcaaaagacagaattccggtcgtttcgtctggaagaacagacagcggggttcacgcagccggacaggtgattcattttgacactccgctgtctatcccggctgagagatggccatatgccttaaatgcactgcttccggacgatatcgcagtcaaacaggcagaaattgcggatgatgggttccatgcacgatttagcgcagtcaaaaaagaatatcgctactttgtatacacggagaaacacccggacgtatttaaacggcattacgcttaccatttttcatatcgccttaatgtgcaggacatgagagaagcggcaaagcatcttatagggacacatgattttacgagcttttgcgcggctaaaacagaagtgcaggacaaggtaagaacgatatacgaacttgattggactgagacggctgacggcctgcaaatgcggatcacaggcagcggtttcttatataatatggtcagaattattgcgggtactttgcttgatgcaggtattggaaaaatttctcacgatgaggtgaaatccatgctggaagcgaaggatcgcgaagcggcagggcgcacagcgccgggacacgggctatatttatggaacgtttactatgacaactaaaccaggtgtataatattttcttgacagagtctgcataaagttataagatatcatatggtatgtatttcaaccccacgataagccccggaacttattgtgttgtgaaatagaacgtaatcgaagtttattgaaaatgacagatcatttaggagggaaattcaatgcgtacaacacctatggctaacgcaagtactattgaacgcaagtggttagttgttgatgctgctggcaagactttaggtcgtctttcttcagaagttgcagctatccttcgcggaaaacacaaaccaacttacacaccacacgttgatactggagatcatgtgatcatcatcaacgctgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaattaaaaaggaggttaccaatttggcacaggttcaatattacggtactggccgtcgtaaaagctctgtagcgcgtgtgcgtttagttccaggagaaggccgtatcgtcgtaaataatcgtgaaatcagcgaacacatcccatctgcagctttaatcgaagatatcaaacaaccattaactttgactgaaacagctggcacttatgatgttttagtaaacgtacatggaggcggcttatctggtcaagctggagcaatccgtcacggtatcgctcgtgctttgcttgaagcagatccagaataccgtacaactcttaaacgtgcaggtcttctgactcgtgacgctcgtatgaaagaacgtaaaaaatacggtcttaaaggcgctcgtcgtgcacctcagttctcaaaacgttaattttacgttttcaaaaagctctcgaccttgggttgggagcttttttctttcaataaaacgtggcagcttcgcataaaaataacaactgaatggacgcttgacggggttaagcaaattgtttgtttataaacggtcttactgtaataatcatgatagctttcattcttattcaattggaaattcggtcaatgtttattatcgttatgtgatcagcccagctccatctaaccactgtatctcatccgttaaagttcactgctgattcttaacccggagaacaatagctctcattgctaatggctttatgtaacgaagtaaaagtaaatctgatgatataaatcacatatctcctttgtgatttttttgcgtttttatgaacttttttctaaatatgcaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgttgagcagcaggttatcgaacaagcaaaaaaaggaaattgggatataagggtaacaccaatgaaagatgtaccgaaggattggtttccgcctgtcaaaggactgaaagtactctgtttagcatcaggcggcggccagcagggtccagttttggcagccgcaggcgcggatgtcaccgtactagataactcagaaaaacagctgaatcaggatagaatgattgctgagcgagatggtctcacgatacacactgtcaaaggaagcatggacgatttaagtgtatttaatgatgaatcatttgatgtcattgtacatcctgttgccaatgtttttgttgagaatgtcctcccggtatggaaggaagcgcaccgtgtgttgaaaaggaacggcgttctaatctcgggttttgtcaatcctgttgtatttctgtttgatacagaattagaacagcaaggtgttttaaaagtaaaacactccattccatatgctgacccagaagatcttccgaaacataaagtgaaaaaactgatcgaaaataatgaggctctggaattcggccattccttagaagaccaaatcaaaggccaaattgatgccggttttatcgttactggtttttatgaagataaaggcgggtttgtattagaccaatatatccatacatattctgcaacaagaagcatgaaagtatgaaaagcagcgacctgttagaggggctgcttttttcataactacttacagaacatttgttccggatcctgcggaaagctgattttttatcgattttacaccttcatttgggcgaatttccaaccgaattcgggcattgtttcatcatccaaacctcaaaataatcggtaaaaggagagtgaatttatatggcagaagtactgtcttttatggatgtgaaacgccaaaaggattttgaattagaaaagaacttgctcaaagaactctctctgagacaaattatccagtctgttaaggattgtttggaaccattatttccatttttacatgatgaacgagatattattaccgaaggctgtattgattttgctatagaagcctatttgttaggcgggcgttttgggatattcggctattacggagaatccatgcagagtatcagtgcccgctctgcaagagaagaagaagagctgcgtatggagttttttgattatctctataattggatacacgagcaatacgcaacatttgataaaaacactgtttatgaagcggcacgcaagttcattaaagattggtggacagcagggtttgttcaaagagaaaaacagtgtaagcttcgcatgcggtaatcatatttcccggccctgtcccatagttatgtaataacggacaagcgggaggggaagggatgaggaaaaagcttaaatggctcagttttttgctaggcttcatcatattactatttctgttcaagtatcagttcagcaataacgactcttggaagccgtggagcctgcccttgagcggtaaaattatttatctagatccaggtcatggcgggcctgacggcggagcagtcggcggaaagctgttagagaaggatgttaccctggaagtggcttttagagtcagggattatcttcaagaacaaggagcgcttgttatcatgaccagagaaagtgatactgatctcgctccagaaggaacaaaaggctatagccgacgaaaagctgaggatctaagacaacgagtcaaattaataaaccattcagaggcggagctctatatcagcattcatcttaatgcgattccgtcacaaaagtggagcggagcccaaagcttttattacgggaaatatgcggaaaatgagaaagtcgcaaaatacattcaggatgagctgagaagaaatctggaaaacacaacccggaaagcaaagcggattcatggtatctacttaatgcaaaacgtcaccaaaccgggggcgcttatagaagtcggatttttatccaatccaagtgaagcaacgttgctcggtaaaccgaaatatcaagacaaggtggcatcttccatatataaaggcattttgcgatatttcacagaaaaaggagaccctccggagtaatggagggttttcttgtggttctaagcataagacacccgccatttatgtatgatataataatagttgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaatttcgggcgccgtcagctgagaaaaaaacattattaaatatggataacccgccagtctttcttgccgtagcaagcggaaaaggcggcgtaggcaagtcaactgtgtccgtaaacctagctatttctctggctcgtctagggaaaaaggttggtttaattgatgcggatatttatgggttcagtgtgccggacatgatgggtatcactgtgcgtccaacgattgaaggagagaaacttcttcctgttgaacgctttggagtaaaggtcatgtcaatgggctttttcgtagaagaaaatgctccggtcgtatggagagggccgatgctcggcaaaatgctgaataactttttccatgaagtagagtggggagaagtagactatatcgttcttgatcttccgcctggtacaggggatgttgctctcgatgtacatacaatgcttccgagctgcaaagaaatcatagtatctacgccgcatccgactgctgcttttgtcgcggccagagcgggctctatggcgattaaaaccgatcatgaggtcgtgggggtcatagagaacatggcttattatgaaagtgcaaagacaggggaaagagaatatgtctttggaaaaggcggaggagataaactggctgaggaactaaatgtgcctttgctcggcagaatcccattgaaacagccagattgggataaggaccaatttgctccgtctgtttatgacgaaaatcatccaatcggagaaatatatcaggacatcgcagaaaaaatagatgcaaaaatgtcagtgcaggtataaaaggtgaaccgggattccagatcccggctttccctttattcactttctttggctgtgtcttttgctgcttttttcagctcatcttcgaactgctttttgtaaagcgggctagaaagtgtttcgttaataacctcttctaaataactgcggaattcttggctttttgccagctggctatactttttatccatgccgggatcctgcataacgctcatcagcatcttctggtaatctggatccttcatcagctttttaatcactttttcatgctctgtctgaagagttttggcaaagccctcagcaaaatcagtgtcttcaaagatgtttttccaaaattcttcgccttttttagatgtgagtgttttttctattgttcctttaattgcatcttgatcaatcaccagcgcttcattcatggcatcatcatttaataattccttaatagctttctttccatcatcagtttttaatatatcaacaaccatttttttggtttgatcatagtccatatccgctgcttggtcttttggagcgcaagctgttacagataataacaaaaaacagctcatcaatagcgttttggcttttgacatgcttaagctcctttcacatacttgtcttacctttaatatgattcatctgtttggaattatacataacaaaatatcgctgttcgcgatttttgaggggatgaataaagaaatgaaaagccgtggtttagttcgttttttcttttctattttagctgtcggagcgcttatcacgagtattgtgggttttgctttaaaatggggagaatatagggggctgtttcttacatttgaagcggggcagattttctctgttttattttggtttatcggtgtaggcatgattttcagtgtgatcagccaaatgggttttttcgtgtttttaacagttcatcggtttgcgcttgagatattaaggtcctcctctttgtggaatttgctgcagttgtttttcatcctgtttgttgcttttgatttaatgtacgtgcgttttttattttttggagagagcggagaatcgctggctggctatgcgtggttaccggtgtttttattgatctttggagtgattacagcttatataaagcaaaagcagtcctctaagaaaacatttgtgtcatcattatttttgatggtcgtgattaccgcattagaatggttccctgcattaagagtaaatgatgaggactggctttatttaatgctttttccgttaatggcatgtaatgccttccaattgctgatgctgccgaagtttgcagcaaagtaattactttacctctgcggatttggcatcagaatttgcgatgaggtcacccacggttacattttttaatcctttttctttcagctgatggatgatatcaggcaatgcttcttctgtttgttttgccgaatcggaggcatgtaaaagaataatgtctccaccggaaacttgcttggtcacattgtcgatgattttttcaactccgggatttgtccagtcttgagagttcacactgtaatgaacgactgtataattgtattgctttgcgacctttagaacattcttattgaattggccggtagggggtcttaatagctgtatgtctttgacccctaacttttcaaaggctgtttgcgcacggtttatgtccttttttatttcgctgctctctaaattggcatagtttttataagcgtagcccatgctcccaatttgatgtccatcctttacgatacgggccactgtgtcgggatggcgttctgcccaagaagcggacaggaaaaacgttgcgtttttaatcccgtttgctttcagagtattaagtatcggttctgctctctcatcaccccagctgatatcgaaagtaagtgaaatatctttagagtctgtttctcctttataaatggctttaggtccggtgtcagttgaaaacacgggaagcgggacagctctttggatataaaaaaagctggcagctgcaaatgcggcgataagtataataattaattgtttcacccgtttaatgtgccacacatagaagtgattcactgatgatgcctccttatcttgtccatcattcttgttttacatcttatgagcatggacaattgaatataaccgataaaatgtctcttcacatacagcctaaattgggtgttgaccttttgatgatatccgtgatatattattattcgtcgctgataaacagctgacatcaactaaaagcttcattaagtactttgaaaaaagttgttgacttaaaagaagctaaatgttatagtaataaagctgcttcgttaagcggcggtaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcaaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctacccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatattgttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttattaaatgtattattaccaaggtttctcataaggagaaagctttttttattgcgatatgcggaagtagttcagtggtagaacaccaccttgccaaggtgggggtcgcgggttcgaatcccgtcttccgctccatttatcccaacgggatattgtaaattgaattgcgcccgtagctcaattggatagagcgtttgactacggatcaaaaggttaggggttcgactcctctcgggcgcgccatatcttttaatagaatagataggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaaaaaaagttgttgactttgaagaggtgacattgtatactaataaagttgctttaacaaagcggacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccgctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaattgcacgttagtgtaattttttaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcaaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccgggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgttttatatctctactgattttttttcttcggtacattttatcaagattctgctttttaagttttctaatactttcaatcccaatacaatccccagcatgatcaacatgagagtcataaataatcaaaatgcagtttgaacgggagactcatccagaatccatccgactgcaattggcagggtagtgccgccaatccattggcagcgagcagcatgcctgtcgtttgatctgtttttccatgataaaattgattggtgacaattaagataatggcgaacatgccggccataaataagtcctaagaaaaactaagaataatccctgcaaaagttgttttattgattgccaaaatacagagttaaatgaggccgctaatatttatcagcctgagataatgatgataggttatttttttggaaaccggctcgggttgccaaatgagagaaaagatattactgtcattaaaacgattcttggtttcatccggatatgataaaatgtctcagactatatttgagccatttttttcttcagcaatcatcttgcgtaattgataaaaatttattatgatactctttgtatgacaactccttgcctcaatacaatatactcaacgtttccccgttttccccggtcgtttttcttttcattttctcccgtaaaataaaaaagctcccaatacaatagatatggtgcggatttattttttactaaaaaggagtcgttatatttgaataatagttttacattaaaacagcaatggttcgggaatatccgaaaagacattcttgctggcattttagttgcgttagcgttaatacctgaagcgattggcttttctattatagccgatgtggatccgatggtcggtctttatgcgtcattttgtatcgccattattatttctatttttggcggcagacctggcatgatttcagctgcgacaggctcaatggcagtcgttatggtgtcgctggttgctgatcatgggcttcagtatttatttgcggctacgattttgacaggcattattcaggtgattttaggtatcagtaaaattgcaagattaatgaaattcatcccgcgttctgtgatgatcgggtttgtgaatgcgctggcgatccttatcttctctgcgcagcttccccagtttgaaggtgcttcttggagcatgtatgcgatgcttgccgggtcgttggttattatttatgtgctgccaaggtttacgactgctgttccgtctccgcttgtggcgattattgtgatgacaattattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcgcagattattgatgaaatgacggatacggacagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgtttttctgatgtttttaattgcggtgttaagtcatgtcgtggtgaaaatcccaatggcggcgttagtggctgtaatggttatggtgtctgtcggcacttttgattggtcttctttaaaaggtctcaaaaaagcgccgctcacggactcgattgtcatggttgtgactgtggttacggttgttgtgacggatgacttatctaagggtgtatttgtcggtgttcttttaagtgccgtgttctttgtagcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgcggccgcacttgataagattgttgcgaagtttaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttaacgccgactagtgtggtgttgggcgtgctgctgtctcagtttttaaatgggtatgaatgggctgtgccttggatctttgcttttattacgtttgcaggcagtttgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttagttgatactgtgctgtcaccgctaatcgtaccgctgagtctttcattgctggccggcgctcaggttcacatggatgtgtggggaatgatgaaaggtctgattgtaatggtcgtgattccttcttttttgggcatgctgtttaatcagatgtcatctccagaaagaactgcgtctgtgagcagtgcgctgtcgcctttttcaaagctttgtttgatggcagtgattgcgattaacagttcagcgattgctccttatttcaaatccattgatttgagatttgcaggaatagctgtaacggtattctttatcgcgttaacaggctatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgatcggcatgctgtttcagcagatattggctgctttgtttggctatatgctgaatcgttttgaattaaaaccaatgttgcagaaagcataaaaaaaccgctcatagggttgagcggttttttccgtatagccattcgagcgcgttgatgaactgtttgcagaaatacttgcggtggtgcaccgctcctttttcaattgaaagacacaactggtcttcagtgaagcctttttcttttagactttgatgaacttgctttgtttttttcagcatatgtcgctgaatggattgtttttcacggccttcttcactcccgatagacatgaaaacacgtgcagtgccgggctttaaagaagatatatgaatggtttccgctgcgttctcgtaccagtatgaacctgatatagagcctattttcccgaacattgacggatattttaatatggcgaacattgagatgaggccgcctaatgaggcaccgatcattcctcttgactgcggttccctggtgacgttccagttttcttcgattagcggaatgaactggttcgttatatcagacagatagtgatatcccattccgccgaagtccgtgaaccgatcactgagtgatgcagccggccatggggtgtattcatcaagccggttttcgggttcgataccgatcagcacgagttcagggagcttttgctgttgaaatgcgctttctaataattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctcccccttttttgcttgaaaagcagatataagaaataaggaactccgaggatcgccaaaatgatgcctgcgggcacttctgcgggctgaaaaaacagttttccagcaaagtctgcgcttatcacaagaagcatcccgattaaaccgctcagtggcaggatatagcgatgttcgacgccagccagtctccgtgagatatggggagcaattaagccgacaaacgccatacttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagaacggctgtgatatacgtccagttggcagaccagatgcttccgtttttccacaccatggccatttgatagtcttgcgggtccatttttaaagataaaaacaaagacagggcgctgaatcctgaattgatcgcaattcctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccagggtcagcaagcccgtttctcgtgatggcctggataacagcgcctgcaatgccaagaccgagtccaataatagcagccatgacaacccgcggcagtcttaaatcgaacaacaaaatttcatactgcggattcgggtcgatttgaaaaagagtggagagcagctcagcaggacgaacagaaaatgatccgctcgttaagctgaaatagctgacaacaagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggaacacggaatcagcctgctgtaatcagagccgacgagaaatctcgtgatatgcggaacaaccaacccgacaaacgcaatttttccggccagcgctacggcactgccggttagaatgatgacggaaagcatcgccatgattttaatggtttttttcttttgccccaggcttttagaaatgtcgtcccctaatgatacagcggttacctttttgctgagagaaatggccattataatgccagtcaggaaaaacggagcggcaagcttcaggaaatctggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacaccgctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtaatgccctgcataagcgctccagaaacagcaagggctgcccctatgagcagagcgccggcagcccttggaatccgggaatgccatataatttgatggtctgtgtttcccggatcgaaatgaataagagatgtaaaaacaatatctgtgctgagatgctttgccccataaaggattgaaagcaaaagtgacagcgctatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatgatcttctttgactgctttaaggcttttccagattggatttttctctaaatcttttaaggcatcaggtttgtctgcattttcatcatcagaaaattggacgaaaatatggtccgggttcatttcacttaatttttctaatgaaatcagctcttgcgcttttgcagcttttacttcgtttggcgccttaaggcctaaatcaccgtatagtgtggagttgaaatacacctgttcagggtaaatgtaaatgttgccttgtctgattctgatgacaagcgcttttgaatctttcgctttatcgttgatttttgtttttgtttcttttagatcctgttcatagtctgcaataattttctttgcttttttctcttttccagtcagctgggcaagcagcatcatgttttccttccagtttgaagagatatgagaaactgggatcgtcgtgcctgctgtgctgattttttgcagcgttttttccggaaactttgttgaagcaaggataacatctggcttcatttcaagaatcttttcaatatttggctccattttttctccggttggtttggctttatcagtgatgtctttgaacatatcagggaatttgccggagaatgaaattgcgccttgcggatgaacgtcaagcaatttcgcgtcttccattgattcaacgcttcccgtaatggcgattttgtctgtcggtacagttacttcatatgttttatcaagatattcaattttcttcttctcagatgctgtgccgcttgccttgctggcagttgatccatttttgctgccgcaagctgccgccgtcagcgcgagaagcaagattaataaggtaagagatatctttttcatctatagagcctcctgttcaattgataactattatcaattggaattatagagaatgaacagatataacaccatggacaaatttctgatttatcatggacaatctccggatagtaaagaaacagtttgctgaacaatgcgttcgtgcccgcaagctgagtattcattccacgggtcaagggatagaagataaacacggttatctcgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgtgccagatagaagttttgcttatgcagcctcaaaaagagaaaacgcagcccttgaacgtgctgaagtgtttttttggcggctgttgtctgctggtcataatccgctagccacttttctgcttcggactcttcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgtgataacgtgtacaggttttcttcccacttttcattaaaccggtatgcactaagctggacgggtatatctgtcgaataatgctgatagtagtaagacgtccatttcggatgcagagcggccgcaaaaggtatgtggtgaagagggatgagatagcccattgtgccccttccgtatgcggcgattttctttcggcgttttttcatatagcttgtaggtgaacagcctgtatattttttgaagattctgctgaaataaaattcatcttgataaccggtttggtgtgcgatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaaaagatcataaatcaggctttgtacttcaatcacacattttagctgagaaagctgagacgattcattccatagtgcggcaagctcttgaagccggactgcaagattttcgatatgtgaaacattcataagcttcagtttggctaattccgattctgtgcacggtgtgtaaatatcttggccggcttccttgatatagctttgaagcctgatcagacaggcatctatatgtccatcggctgctggcataaagccaaaggtctcgttaggcggacaaacataaagtgtctttttttgcagaggattggtgtttgttccgatcgaaatatagccgtttccttttaaatgaaaaatcagcacgaatgaatcggctaattgctgttctgagaagagatcacttgtcttttttagatattcaatttgtaccggttgataaatcactgcattttgcacgagtagaccaccttttcagaagctttcaattgataatcattttcaataaaaattgtaccaaataaatgaaagttttcctatataaagcgggtgggtttttagcatgaaaaaaacccttacttatgtgtaaaagtaagggtctttcgttcagtaagaatatgttacacgtgtaacatacgatgcttacgttctaataaatgagatatttttttcttgttttgctgaattgttggagtgttttttcatagctgtttatgatgtcctcaaccgaagttccattttcaatttttgtcctgatccagccgttgcctgccagtttatcgaatgaacctgttgacaggaactcaaaatcctcaggatagagatcgtgtatggttttaatgactgaaagacccgttttaacggcttcaaacttatctctgtctgtcacatagagctgcacaccgtggcaaagcgttccttgatgtttagaaaacgtcggtgtgaaggatgctgccctaaatgttacgcccggcaaatggaggctgtttaatgtttcttcaagttctgtgcttttgataaatggagctccgatcaattcgaatggttttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatctttcgtttccagtgtttcatttttaccactgtaagatcggcatcaatactgaattctttgttgaacagtgaagccaattcgcctatcgtcatcccatgcttcaatggaatgggatacaatccgacaaatgaggcgtattcaggttctaaaattggtccttcaatatgattcccgccttgaggatttggacggtccagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggaaccccggttttttcgtcaatgtaagagcctacttcgtctccagcctgggcgtcacctcggacgccgtgttcagggccgaataaagctgtcagtttgatatccgggttctcgtaaaggatatcgacactgcttttcagagatgcgtttactccggttggattggtgatcagtccgatacgttttcccttgagctgttttttatagtctggcaagagcgtgtctataccagtttggactttaggttttttagccgtttgattctttgaatcgggtgaagcagaggcagcggttatcgttccgaacatcatgagccctgtcagaaaagcgaatattgtttttctcatgtgtccctccttattaaagcggttttcccgttttgatatttaatccgtagccatatggataaagggtgtcccccgggttcgtgactgatgggatgttaactggaagtgtgcctttaggttttgcctggccgaaaatcgccatcactccggccggaatattaggttgaagataacggccatttgcgtatcctttaaagccatagactgcaatcagtgcctttgtttcttcgaaattggcggcatcatatgggttgcgcaggctcattaagacaaatggtttgttgtgctgcagtgcggctttcatgacagctctcggaaacacggtggcccatttgcttgaatctgatattgtgtcgtcgatgacaccatcgttgacgacagggtcatttttgacgacataggagccggttatgatataatcagccttttttacttgttttgcatgctcggcattaaatacttggttggcaaaattcattttgtcgacagatacgggtttgattttctttcgcttgatgagatcgtgaatggtttgttcgattgaagcagtttgttcttcgtaaggtgcaacaattaagatgtggctgccttttttaggcttgaacggcaaagtgtgctgttcattttttaatacggtcactgctttttcagctatttttttctctgctttgaggtgacgcttgcttcctacgattttttgggctttggctattttttcgtttgtactgtcgctgtttcgcgctggatacatgccgcgttttatttttagggaaatgattctttcaactgatttgttgatttgttgttcagggatatccccgtttttcacggcttctttcaaagcttgaataacacgtgcgaatttctgttcttctttcattgaagtgactgaggctggcattaatgcaatatcgacaccagcttttacggccatgaccacagcctcttcctgtccgaaatgatctgcgattgccttcatattgagcgcatcggtaacgatcacaccattaaagcccatttcctgacgaagaagacctgtcatcactttttttgaaagtgtagctggaaccagaatgtctgatccatcgagtttgcttttgtatgtggtgtcgtcgaaggcagggaattgaacatgggctgtcatcaccatatcagcaccggcatcaattgctttttggaaaggatagagttcgacctcccgaagccgttcttggccatgggaaacgagcggcagtccataatggctgtcaacgtccgtgtctccatgtcccgggaaatgtttgagggcagacgcgatatcctgccgctgcaaccctttcatcgtatatagaccgaggcgtgatgtcagttctcgattggagctgaatgaccgtacgccgattacaggattatcaggattattgttaatgtccacgacagggctgaaatctgtattgatgcctaaggcagagagctctttcccgatgatgctgccggtctgatacgcattgattctgcttctggctgcgcccagtgccatattccctgggaaattagtgccctcccctaaccgcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccaatttctaaaatcaggcatcagcatctggccgagtttttcatctaacgacatacgattgacaatctgattggcatcgattgaacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttctggatcaataactggtgtatgctttttatttgttaacaatgcgatgcctaaattgtatgctggatcaataattgtaactgtccctgtccagccggtatgcccgtaagcattttcactggcatgagggccaaacatccattccatgcttttacttccgttccgcctccagccaagagcgaatgtcgggtctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccatccattgagtaaaacgctttttcgtcatgcacctctccttgcagcgtgtttgtgcggatgttagggaattgaataacgccgtcacgtgtattgcccattcgttcagtagctgcgaactgtttcggtttaaagcccttttgcagcggattgtacaaggtatgcttcagcctgagcggtttgtagagctcttgctccgtgtagacatcaagcggtttgccagtgagtttttcgacaatacacccaagtagcatatatccaatgtcactgtatacgtgctttgtcccggtttgataatcgagcggaattttcgtcaaatattcaatcgttttgtcccgttcttggaatagtacttgccggctttttccggcgtgtaaaagtaaaagcttgatgggagccctgattggtgctggaggacatcaatgacacgtatcttgtcttttccttttatgaggtcacccggctgatccttgaaacccggcaaatatgcagaaactttttcatagacgtcaagttttccttggctgactaagcgctgcaatgcaaaatttgttgcgtacatttttgtatttgaggctaagtcaaacatcgtgcgggttttcattttggccggacggcgcagcagttctgacccttcgtactttttactgtagccgtatgcttctttttttatgatgcgtccatccttcaccaccacaagaacggcgcctggaaatcctgctgcaatatcccgttctatcatctgatctaccttccttagcttcttcgtcgagaattgtgcagtttctgcatttatggttttcggctcaaccaagttgtctgctgtttgtgcgaaggtttcatttggcgcgaatatcgatagggttaaaatggcactgaatatgaacagtgtctttgttttcacaggctagcccctttctgtgcttctatcccgtttactatccctaaaacagaaccatttaatcgaactgagaagccatttcatctttatatccgaatgcataggtcaataaaaaaccggccgcataggaaataaagagcccaacgatatacaggatgatttgcgaaggcaggactagaaaggaaagcggcagtccggagacaccaatcgcaatggtggctacttgaaaatacgcttgaaaggcaccaccgattccagctcctaaacatgctgttaaaaacggacggccaagcggcagcgtgactccgaaaataagcggttcaccaatgccgagcagtcccgatggaagcccgccggcgattgctttcctcagtgttgtttttttcgtcttcatgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcctgcagcgatgccgccgatgtccaggatggacagaaggccggatgtaatggcatcagaaatgaatccgcctaaaggcataaatacgacatacgttacgattccggtgattaacagtgaaacggtgggtgtgacaatgatatcgagtgattgaggaataaaccggcgaataaattgttcggtgtaagcaatgaatatggctgcgaaaaggacgccgatcagacctcccctgcccgggagaagctcttctccaaataaactgatttttgcgatctccggattgataatcaagatcccggccaaagccccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggatgaaaatgctggcaattttacgtaagaaaagtttaaaaggagtggcgttttttcgattgatatcggctttctttttggccgcagcttctttgacatcggcaccttcttctgctgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagatgatggtagttattttctttgctcattaaaacccctccccttcaagatgccttattttattctcatagattgtatggctgctctcgttttatcgatataaccggttgtcgtttcatactgctcagccgccatgcctaaaaacaaaacatcaattataaaaagctgggcgaggcgggaggaagtggctgcacttcgaatcaaggcttcattggaatgggctgtatacaaagggacatcagccagtgcggagacggatgtctgactgaattgtgtgaggctgatcgttgtgatgcctttttccttggccatggcaaacagttcaatgatttcctgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcaggtctgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggaattttcattgcaagtaagggcgatggtgtgtgctccgactttgcgggcgtatcttagggcgcctgcggcgtacggtgtgcggccgcttgctgcgatggcaatgacggtgtcatttgaagtgagctgtatgtttcttaaatcttcagctcctgcttcttcactgtcttcaatgccctctgctgcctgtaaaaaggctttggggcctccagccatgattccgatgacctgatctgggcttacgctgtaggtgggaggacattcaacagcatccatgacgccgagtctgccacttgtgccggcgcctgtatatatgagccggcctccattttgaaacgattcatatgcgcagtctacagctgttttgatgtcggggagaacctcctgaacggctgcagcgactttcatatcttcgttgttgatcattttgaggatgccgagagtgtttgctttgtggatttcaactgtttggctattgcgtgattccgttgtaagacggtgaaggtttaatggttctgacatgaggatgccccctgttttaaaatgatatatctcaatattcagtatattcatctctgttatgatatttcaactatgtttttaaatttttgaaattttatttcactcaagactataagaaatgatgaaggatcaactgttctccaagcgggccgattcttcgccgtcctttatcaaggaacccgcttttcatataaaggtgttttgcgcgtatgttcagatgattgacggccaagatgatttcgtcgcaccatggaaaatatccgctcacaaaagcgggaagcaaaagcatggcttttttcgcatagccttttccgtgatgcacagcgtttaaagacagggagctgagcagtaaagcaaatggattgttagaataagaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattggagctcgggcaagtgttcaggcttatagaaggataaagaaatgtcttgagtcatggggtggcctccttacaatatgtcgttaagctcgttttccgaaatgacgcggtagcccgcttgttttaacagtgcggcggttactccgctgccggtgatttttttgccagagaatgtgccgttatagataaaaccgcttccgcaagatggactgttttcttttaatatgacggcagaagcgttgatttcttttgcgtaagccaatgttttcgcggcgccttccatatatagttctgtgacgtcttctcctgaagctgtcacgattttcgctgttccattgaggacatcctcgccggtgcctcctatgatttctgcgggttcgcgtggggtagagaagccgccgagaagttcagggcaagccataactgctttcttttcatcgacgagttttctgattttctccgacgctgcgtgagagccgttatatctgcattcaatgcctccaaggcaggaactgactagaatcatattgtttctcctctcttgctttgcttgtctctatcataaaataaatggctttagttgggaggctttttcagttaaaaaaggagttaaaaagtttgaaaataaaaaatttaattttcctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcgggaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccagaatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaatgaacatctggagacatgcgagaaatgcagaaagcatttttacgagatggagaaatccatagcgcttgtacggagcacatcgcatgtcgaagcccccgcggattttaccgctaatgtcatggcaaaattgcctaaggagaagaaaagagcttctgtaaaaagatggttcagaacccatcccgttatcgcagctgctgcggtattcatcattttgatgggcgggggtttttttaacagctggcataatgaccacaatttcagcgtgtccaagcagccgaatcttgtggttcataaccatactgtgaccgtaccagaaggtgagacggtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcaatccgaacggagaagagtaaagcgcgttagccgctttgctctttttttgcgggctgagagcgctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccttgcttaccattgagcgggatactggaatgggggattatattgagaccggcataccactgaatgccaaagtcagctctgagctgctgatcaatatttttatcccaaacaccccgcttcatgacggtgcggtgattatgaaaaataatgaaattgccgcggccgcctgttatctgccgctttctgagagcccgtttatttcaaaagaactgggcacgcggcacagagcggctgtcggtatcagtgaagtaacagacagtttgacgattattgtgtctgaagagaccggcggcgtcagtgtggcaaggaacggcgaccttcacagagagctaacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgactccaaaaaaaccgggtgaatctttctttccgacatcaacaactgatgaagcaactctgactgatatcccggttaaagcgtattatgatgatgaaaattacgtcgtgacgggtgttccgcaaacggttaatgtcacgataaaaggctcgacaagcgccgtgaaaaaggctcggcagaccaagaactttgaaatatatgccgatatggaacatttgaaaaccggcacgcataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaagttcgagaatgtccctatcaagactgtagggctgagcagctcacaaaacattgaatttcttgatcctgaatcacaagctatagatgtaacggctaaaggctctcccgcgaatataaaaaaactgaaaaaatcagatattgaattgtatgtgaatgtttcagatttagaggacggggagcatagcgtgaagcttgaagtgaacgggccacagaatgtaacttggtccttggggcggaaaaacgccaaaatcaagctgacgtctaagaaaagcaatacatcaacgaatgataacagcagcaatacatcagggaaccaggatgacacagataaacaaacaaatgatcaaaagaacaatcagcaagaagatacaaagaacactgataaaaacaacaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaagaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgcccatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatcttggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatactttggtttcaaccgtgatgagcaacctcggcttctataaggcgctcgaaaaagaaggcatcaaaagcgtacagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttgaaagccacaggcaagccactgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggattacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaggcgaaagccggaattgggcatactcgctgggctacacacggcgaaccaagctatctgaacgctcacccgcatcaaagcgcactgggccgctttacacttgttcataacggcgtgatcgagaactatgttcagctcaagcaagagtatttgcaagatgtagagctcaaaagtgacaccgatacagaagtagtcgttcaagtaatcgagcaattcgtcaatggaggacttgagacagaagaagcgttccgtaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcaatggcgatgcttcaagtaaccaacgaatatgttgagctgatggataaagaaatggttatcgtcactgatgaccaagttgtcatcaaaaaccttgatggtgacgtgattacacgtgcgtcttatattgctgagcttgatgccagtgatatcgaaaaaggcacataccctcactacatgttgaaagaaacggatgagcagcctgttgttatgcgcaaaattatccaaacgtatcaagatgaaaacggcaagctgtctgtgcctggtgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcactcggacacaaagccctgacaatcacaaacgtacctggatcaacgctttctcgtgaagctgactatacattgctgcttcatgcaggccctgagatcgctgttgcgtcaacgaaagcatacactgcacaaattgcagttcttgcggttcttgcttctgtggctgctgacaaaaacggcatcgatatcggatttgacctcgtcaaagaactcggtatcgctgcaaacgcaatggaagctctatgcgaccagaaagacgaaatggaaatgatcgcccgtgaatacctgactgtatccagaaacgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcacgtaaacctaagcatccgcggaaacgtcaaagaagttgccgctcgcggagcaaacacatgcatcatctcactaaaaggcctagacgatgcggatgacagattcgtactgccggaagtaaacccagcgcttgctccgttggtatctgttgttccattgcagctgatcgcttactatgctgcactgcatcgcggctgtgatgttgataaaccgcgtaaccttgcgaagagtgttactgtggagtaataaatgtttaacccctttggataagattgtctaaaggggtgtttttatgtccaaaagagaaagaacgtctacagtggaaaaatggattaaagaaggtgattgtacaggactcgactatcgatcggccatggctatagatttaagatgtttcctcataaggccagttaacgagcttaaaaggctttaaaactagtagactgcatgaatttttcagtggagcgaaactgcttttactttcacctgaattttcttatgtaatagcagaccggagagcctattgtaatgacaacagattttttatgacatttaataaggggcgagaaattcatgacattaaaatgaaagatgaaaagagaatgtacttgtgggccttaggttttaaaattcattcttttgttattgagtacattccggtttaagttgaaatgattcagtaaaggacacgccataaataaaaggtagcgtatgattgccattctttccatggaaccgatatttctaagatttcatctttcgtaggctttcggttcatattacgtaatatttttatcgaatgaataagacccacatcatcgattggaaaagctgtcgggaacctaaggcagcgcattagaacataattggctgtccaaggaccgattcctcgtattttaattaagtttttttcagcatctttaaagttcattttcattaatttttccctcgataattctccacttgccattaatctggctattccaatgatatattcacttttttttaccgtcattttaatatctgccaggtcggtaggggttaaccgtgcaattcgttcgtacggtgggaacacccaatactttttaccattccattcaatagaatcgccaaatgcttctacaaattgcttctttaaggagtacgcgaaggctaagttaatttgttgtcctaaaactccccaacataaagcttcaaataaatcgggaatgccgataactcgcaacccataaaattttcgggcaggcattttaagtaatggatctgcttttgccatttcataaaatggtgttaaatcgttatcaagatcaaaccattcatgaatatattttacaatctcttcccgtttccactgctcaacaggtctagaatcgtttaggaattgaacaaccatttgtttattattgattacgcttacctgcactaaggaccgaatttccccattggctataacttttgtaatgatattgttctctatttcatacatgcattcatttttttctctggttagatagcctaggttcgcattcatgtcgaaaatttcaggtaatgtaatgacaataacatcattgacttcatgccatgtcactttttcattctccttatcttaaataattataagaaaactcacgctggttgaaattagtttatcacataatcatctttactcattttgttatcttgctattacattctaaccaccttatttttttctatttatgaggttatagtgtagttatcaagaatgctaaacgggagtagataaaaatggcccaagatataaaaaacgcgtgtcgaaaatttaaattgggattcaattcaaactgaattagatgagcattgtaaggagaggtgagataaatgccggatagtatcaataacggacataaagagagccatgagcatagaatttcgaatgatgtagaaatgataacagatgaaaagtggcaagcaattataaataatgatgcagcgtacaataatcaatttttctacgctgtaaaatcgacagggatattctgtaaaccatcctgtaaatctcgcgttccgaaaaaagaaaatgtatgtatttttccaaacgcagaacaagctctccgcgcaaattttcgcccttgtaaacgttgcaagcccactaatgaaaaaatgcctgatagcgagtgggttgatctaattactgaatacattgataaaaatttcacagaaaaattaacgctagaatcgttagcagatatttgtcatgggagtccgtatcatatgcatcgaacatttaaaaagattaaaggcattacgctggttgagtatatacaacaagttagagtacacgcggctaaaaagtatttgattcagacaaataaatcgattggagatatcgctatatgtgtgggtatagctaacgcgccttattttattactttatttaaaaagaaaactggacagacaccagcacaatttcgtcaaatgagtaaaatggaggaaacgtacaatggaaacaaataaaccaaccctttattggtctttactaatgttcaaggagtggaatttttatattgcttcaactttaaaggggcttgtgtttgtaggttcacagaacaaaccaatcgaggaattgttcgaatgggctaggaaacgctttccgggaagtcttcttgttgaagatgatgataagcttgaaccctatgccgttgaaatcactcaatatctagaaggaaagcggaaaaactttactgttccagttgagtacgccggtacgcaatttcagctagcagtctggaatgcactttgtgaaattccttatggacagacgaaatcctattccgacattgcaaatgaaataaataaaccagcagctgttcgtgctgtaggtgcggctattggggctaatccggtattaattactgtaccgtgccatcgtgtaataggaaagaatggctcattaactggctatcggggcggattcgaaatgaagacactgctcctcgatctggaaaagcgagcttcatctgaaatggatgttcctcattgaaagtgaatcatctataatgggttggattcttttagaggaaagtaaagaccagtttactgataaacttgacaacttttaaaatttagcatatcttatacgtaacttaataatcgatgcagatgtttatttttccttttaaaatatgtaggcctttagcattcttttcatatttaattttaaatattgataggatgaaaaagtatcctaataaaaaaggaagagaacatgagtcgatttatttgataatcagggctatattaaaggaaatgaaaacatagcataaagtaaagaccaataataaggtagcacttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgattgaaaggtcttttgaccaataatgagttttaaaaaagggagaatttagaatgttagtttcgctgagtttgtcatcattattaacattattttttattatgcttatggcttctgggattagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttgcgctttttactttcacaacaggtactgcttcaatgacatggttaagtggcgatctccgcttgatggttctattttggggagcaactcttgttggtttaaccttacttattaggttaaacagtgcttggcaagtggctagtgaagcagccaaaatttctggccggttatttttgttaagttggttttctttgttttttgcgatgatgtggctttttcatgccacaggtcaatggcagttatcattggttgtaacaaatgaaagtttagctgggctgggagaatgggagagaacagggattcagctattgattgtattagcagtgattattcctgcagctcaatggccgttccaaagatggttggttgagtctattgttgctccaaccccagtttctgcaattatgcatgcaggtttagtaaatgctggaggaataatactaactcgattttcacctctatttcatggtggtatcgcttcgattatcttacttctgcttgctggcatttctgtattgattggaactggaattagtttagtccaggttgattataaacgccagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtatcggctcgcactaatgaaagaacatcctatttatgggccatggctggtcggattttatccttagttataggtgttgctttttggctcactgctcctggggacgggtatcacttaatcagtgcgctgatcttagggtggtcattgtccgtttcttggactcagcttgtcgcttttggagagggccgaattggccgaattgctggcttaactgttttaggaggagcagccctcgtatattttatcattcataaccttttctataagtggctgcatacaaccatttttcaaagtgttcaacctccaatgtcagctgtcatgattgtcgtatgtctcttactctttggcagtgctttaggtacgtgggttgctcgtcatcgttcttccgtttttttcgcggtactctatctttggttagtccgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaggggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatataccctagtgcgtctatgatccgttcagcaaagaataaaggtgagattgatgaagattttgtggaaatggggctgcagcgttggcttgattcacattcctatcacatcccacgggacgtagcagagcgattttgtcatgctgcattaaagttagatcccctgccttccgaccttttatcatcacatgagctggagaaattagtaggtgaatgtagtggattggatcatatcgagaatgtgtttatgcagccactaagttcgtatatagagaatcaagatggtgaaaggctagtcaatatactagatcatcatgtcattaagtggagtaaattatatcttgatgactctcaagcaggctggacaatgcctaatcgtgaggaaggtttctatcgtgcttggcagcatctcattcaatatgatccagcacttagcaaaaagcagcgagaaagggtaaaggattggccgaaagaggcacatttggctttacaggaagccttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatacttacctttgactaatgaacgatctaagaaaacaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggaacaaacgtacactgatcgattaagccagaagatcatctcgaaacaacgtgaaaccggcggtgaaaaatctgcattagctcaattagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttcgttaccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagcggaccttggctaactctgcaaatggcagcccgtagctttgtgccaagaaaggcaggtcgtttcattcgtaatctccgtgaggcttggttacgcaaacctgatacaaaactctcgcttcatcatgatgctacagaggcagaaatacctgtgggttttactgatgaagaaaaagtgaactatgctcgccaagcattaaaaatgatggggttaacagagaacatcgcaccattggtcgtaatttgcgggcatggcagtcaaagcactaataatccttattctgcagcccttgattgtggtgcctgcggtggagcggccggtggattcaatgcaagagttttagctgctttatgtaatctatcagaggtacgagaagctcttttagctgaaggaattaaaattcctgaggatacggtttttgcagcagctgaacataatacaacagtagatgaattacattggctttatgtaccagagctttccgaagctgcacaagaagcatttgaacaaattgaagccgttatgccgaaagtgagacatcatgtaaacgcagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggcagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttattcaaaataaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccagtatttcacatccttatggagaaatcatgaggtctgttatttttgcgatttatcaggaagatgttgaggagatttttgtagtaggaacaaaagataagaagacttccgcaggtaatggactaactcaacttgaaacaatgaaagataaaatacaaacattggattatctctttcaaaattgcaagcctgaatttttaggtggtacggtcgatgaatggctaaatgaaaatagcagtgacaccattgaaaaaagtgttgatatgattcgacatcatccactagtgccgtcacatgttaaagttcgaggtttacttgttaatcataaggatggaaaaccctcaattatggagggtcctgatgctaaaacaggtcaagccatacctgatcattgcttgtcatgatgaaatgcaggttcaacttctaaacgcacctatatatggagaaagcagttctaaggagattgtatgagcgctaatttaactgattttgtcacgaaaacaatagaggaaatgaactcgtttgatcgtgaaaatatggaatgtatgaaaaaactaattagaaaagcaattgatttttatcatctaaagtcttatgaagaagttgaggaaacccattcaggaaatgttcgatttttgcatgtccactctatgatggaagaaaatatgttatccaaaatgatagtggtcacaagaaacagtaaaactgatttggatattgaaggtgtatatgaaggatatgttgtaagagaatattaatgagacgaaatcacaaatagaatatgccaatttttttgctcaggagatgtattagatatgaaaaagtcgaaaggttctattgaatcagagatcagtaagtccattactcaatgggagaaggattatcttggacgggggtctgtatctgttaagactgatatactgcgggacatgatcatcgtcaatttaaaagggattttaacaccagccgaatatgtagtttgtggatcaaaagagggtatgttatctatcaaacaaactcgttcggagttagtcgaatcaggtatagaaggccttaaggatattatcttaaaaataaccggagaaaaagtgaaaagttttcatactgatttaagctcccggacaggtgaacgagtgatggtgtttaaattatgtaatgatctagagaaaaatttggaaaagatcttataatctaaagaaaataaaatgttttgacggtatggaatctgttgtgaattgaacataatgaactgccgcttcttttgttttacaattatggcatcattgataacttttattcatatcctaagcggacataaagagatgtcaattcatagtacactgacttgttattcctgtcgaaagatctaacatccgctgttgttatgagcggatgtttttttatctattttaaatacatgaatttgatgctggtgattagtcacttgaacaatattaaattcactttaattgaaaacatccttgtcacctgccgggttcccacaagtgtttagtgacatgattatgagaccaatttcgtaaagcatgatgataaatttaagaggtgaacaaaattgatatgctgtcttcagtttcatttcacggaattagtcagagataaacctttaattaaatatatccaaaaaacggattgacatatcggaatataacgatataataatcgatatggaaccaattgaagtattcaaagccttatcaaatgaatcaaggctgcaaattttacaatggctgaaggagcccgatcgtcattttgcaccccatgaagggattgatatgaacacaatcggggtatgtgtcagtcaaataacagacaaattgaaaatgacgcaatcgacagcttctcaatatcttaccatccttttaagagccggcttgattaaggcggagcgtattggaaagtacacatattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattaataattaaggagtgaatgttttatgtctaacacttggaaaatttatattttagccattgtcagctttttagttggaacctcagagtacatcatttccggaattttggatcaaattgctcatactctcgggatcactttagctgccgcgggccagcttattaccattttctcacttgtatatgctctttctacacccgtacttatggcgttgacagcaagtatggatagacgcaaattgatgatgtatgccctatgtttgtttgtgttcggtaatgtcctggcttttgtactgcctggttatggatggtttattgcagcgcggatcattatggcgatgggagcaggtgtggtggttgtcaccgccttaacgattgccgctaaaattgcatcggaagggaagcagggaagtgccatcgctacggtcgtgatgggatttaccgcttctttaatcattggtgttccgcttggaagaatgatagcagtagcattaggctggaagtctgtatttggagcaattgctttgttgggattgatcgcaatggtcgttattttctttactcttccgcatactgaaggggataagcctgtgcctttgcttcaacagcttgctcttttcaaaaaacggaaagtggctatgggattatcaatcactttcttctggctcgggggatattctgttgcttacacttatttgtcaccgtatctcttgaacatctcaggtataaatggcaagctgctcagtggtgttttgcttatatttggaattgccagtttggttggatcaaagtttgggggatatagcaccgataaatggggagtaccctttacactcgttggcgggatgacgttgcatatcgtcacactgattcttctgtcacttgttactcattcctatatcggagtgttggtgattctcatattatggtcgtttgccgcatggtctaccggtccgacacagcaatttcacctggctacaatagaaccggaaatgtcaggtgttttgcttagcatgaatcagtcaatgatgcaattcgccatggcggtcggcgcaggaataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagatctaacatccgctcgttatacaagcgggtgtttttttatacgctcaactagaaagcacactgtagctgaaagggatttttgccgacggagagctgaagcacagcaagttataatatactaggaagggaaataacggtatggcggaagggttctaacgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaaatatcaaagatggagggaggctgcgaattgatttaccgcctggtgagcatgttattcaagtgaagattgcttggtgtacaagcccaactttgaggtttactttagcggaaggagaagtgttgaagtttagatgcggaagtccacttcgaggatggaagttgcttttggcgcttttttctgttttgggccgtcctgaaaattatctgtttatcgagcaggaagaagagaaaaagctttgtggtgactttgatgtgtgaataaataggaataaatagattaaatacccctgaattatgttttgtgaaagattgatataagcggtagccttctcaatgtcgttctccttggagaaggctgcgtataagaaattctcggactttgcggatagaccttccgatatccatttcaggattaatgtcttctgggtggagagtccgatttcatcatagtatcgcagtgtttttgttgatactttgcatatctttgaaaattcgccgatcgatagccgagtgatcacctccaagctccaaatgtacacctttccgtaagggcaaagttaaatgtgaaaataaaactgttccaaagttaatcagaaatttattttcatattgtatcctttcagtatcaagtgaaaggagcatcatatgaaaacattatggaaagtcctcaaaattgtttttgtcagcttggctgctttggttttgcttgtatccgtctcggtatttatttatcaccatttccagctaaataaggaggcggcactgctgaaaggtaaaggcgcagtagtcgatgttgacggtaaaaagatgaatgtgtatcaagagggaagcgggaaggatacgtttgtgtttatgtccggttcggggattgctgcgcctgcttatgaaatgaaggggctgtacagcaagttttcaaaagaaaataagattgctgttgtagatcgggcaggttatggatacagtgaagtgtctcacgatgacagagatattgatacagtattggaacagacgaggaaagcgcttatgaaaagtggaaataagcctccttatattttaatgcctcattcgatatccgggattgaagcgatgtattgggcacagaaatatcctaaggaaatcaaggccattattgcgatggatattggattgccccagcagtacgtcacgtataaattgagcggagttgacagattgaaagtgagagggttccacctgttaacctcgattggttttcatcggtttataccttccgctgtatataatcctgaggtgattcggcagtcgtttttaactgatgaagaaaaagaaatctataaagccattaactttaagcaattttttaatgcagatatggagcatgagcttttacagtcttaccaaaacggcagcaaatctgtgaatctgccggcgccaaaggaaactcccgtcttgattttagatgcggtctctgaccaaaatagacattcaaagtatgctatacaaaacagaaaagactataaagcgtttgcggctcaattcaatactgccgatataaaggaactgaggggaacacacagtatttatttatatcagcctgatcaaatatataaactgtccatggagtttatgagaaaggttcgctaggatgaagggttatcatattttaatcgttgaagacgatgtgatgattggtgatttgctgcaaaagattttgcagcgtgagggatatcgtgtgatatggaaaacagatggagcggatgtgctttcggtgattcagaaggtggatttggtcattatggatgtgatgctgccgggtgaagacgggtatcaaatgtctgcaaaaatcaaagagctggggctgggcattccggttatttttctttcggcccgtaatgacatggacagcaaacttcaaggtttgcagatcggcgaggattatatggtaaagccctttgatccgagagagctgctattaagaatgcggaatatgcttgagcatcattatggcacctttacgcaaatcaaacatttgtatattgatgcagtaacgaaaaaagtgttcaatgaaagcctgcatgatgaggtattatttactgcgattgagcggaaaattttcttttatttatatgaaaaaagagacagtatcctgacaaaggaacatttctttgaatatctatggcagctcgaagatagaaacccgaatattgtcaatgtgcatattaaaaaaatcagagctaaaatcaatgatcaagcgggtgagatgattgaaaatatatatggagaagggtatcggctgaataccgttgtgaagaaatgaagctcaagacaaaatatcagttgttattgtttacggccgtcattagtgttccgatgctattgctggcggtcagtgttttgatgtctgtgatttatgacagcatgtttaaaacgatgaatcatggtatgccctttcacaggtcgtttgcgtacccggcaatgatcgttgtatttttgatatcgctcttattgttagcttttttattttcaaagtcgattcattctctgttgcataaaatcaatctattaaatcaaaccattcggcatttggcgagtgatcaaagggtgcccgataaaattgaagtgaagcgtgcggatgaaatcggggaactgatcaagtcggtcaatttgttaattgaacggacgacatatcgtgaactggagctgagacagcaagaggaaatcaaaaaggagcttttgcaaaaactgcggcatgacattaatacacctttaacggctctcaggctgcagttattttatttggaagaccaatgtcatggtcaggctgtattcgaatcattgtatcagcaaatcgaatatatctcggaattaaccaatgaattcaatctatattccgctgagacgctggaaagctcttatattgtaaatgaagaagtgcgtctaaacgagctattagaaacagcggtgaaaaagtgggattatttatacagtatgagtgggattgagctgcactataagccggcagatcaagatgtgatatggatgagcaacgcgttatggatgcaaaggctgtttgataatatttttcaaaatacgttaaagcattcaaaagctgaaaagatggaagtcacgattgaacatggcgatgtttttattcgtgatgacggtattggatttgatcggaatgagagcagtgagggacttgggttaaagattattgaggatacatgcaggctgcttgcgattacttatgagctgcatacaaatgataacggaacggggttcttgttttcaaaagagtgaccccgctgatgtttttctttctcctataaaatttatataataggagaaagaaatggggtgaacagcatatgtttaaaaaaatcatcaaaacgattaagtacctctcaagcagttctagtgaccgatatcgcagacaccggcattacagcagcagtcggcgcagacattatcgcagctacagcagcagttcgggcaaaagaagacactacgaccgttatggcggcagtcatcgttacaaacgccggagctacagcagcagttaatccaaaaaaagttcttgttccgcttttgggacaagggtttttttatgtgaccgactgaatggcccggtttagatcctcgcgaatggaagcggtgtgctgatactcttcctcaatgcccaataatcttttcagcagcaaggttacttcctttgtcagtgttaattcctccagccaagtgccatttttcttcttttttcctttatattgagagtacagcaggaataacagcgtttctccgagatcgaagaagtcatcctgttttcgtacctttatttcctccatttcttcaagagtcaattgtttggcaaggccgaaatcgatgaggcagagcctgccgtcattgatgatgatattaggcgttctgatgtcgctgtggaaaataaggcgatcatgcaggtattctataatctcaagcagctgcgaaatcagttgtaacgccataagctctgtgaacggctgttttcgaaaaaataataattcttctatattctctccctcaatgaactgcatgacataataagcctgtccgtctatgatgaactcatctatgaagcccggaatttgcgggtggtgaatgcttttgagcagttttatttcctgctggaaccggactttttctttttcctttttcgcttttgtcggccgaagctgttttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagttttaatgccatgtctgcacttcccttggttgtactgactatagtttaccttctagactgagaataaaaaagagccggataaccggctcggtataagttaaaactgctttgtcacgtcgtattcataatctatttttgcttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaacgccgctgaattggaatgttccgctgcccgatttgattcggtcttcaattgaaagtgtaaaatacatgtttccggtataggtgcctcgtgacactttcacataaaaggtatctgtcgtgttttgggcgtctgcatttgcataaataaaagaagaaaacgtattagggttaataacttctgtcccttgagaaacaggtattctgttcttgtcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactctgacagctgatgccgaatacgtaaaggtggataagacagacagcataacagcgaatggaataagccattttttcaccatgcaaacaacctccttttatttccatcatacataataacgatttaggtgtaaataaatgttttttaaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcggggcgttcagcaaagtgtatcaatcagcgaatgatcgaacagtgacagacacaggggaagaaacagtgattcaatcccaaaacccctatgaatctgagagtgatatcagaatcaaaatactagatgaaaaatacagcaggatgaatgcgattaataaaacaaagtctgatccattaggctatattaaggataagtaccaaaattcaaagtctccttatttcagaagtgatctgtcagctgcagaaagacaggccgcttacgataatgaaacagaatggctattcaaagggaaggcgcaaaactataacctccaggatgctgcgtttcggaatgtcacatttcatggggaagtggaagctgagaatgaaaaggtgtatcagcggggacaggttaaccagcagctgcaagtgctgttgaatcgaaaccatattcatattccagaggggacagagctgacgtttacaatcacaccgattgactatcaggtgcgggtgagcgggacagacgatcaggatctgatcaagcaaattgagcaagtgctgcaatctggagacaacagcaaagaactatttttacacatcatgaaaagtcaaagcagtgattcaacacaattttccgaagaggcctataaaaagtatcaggcagctcgtgagatgtacgaagtcacaggttatcaattgaaggatttagaagtcattgatggacggtacgtcacgcctgatggacgtgacttaatagatgtatataaggaagagcttgaaaaagatccagtgcagaagcaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaagtaagctgttcatgtagaacagcttattttttatgagaatctaaggggtgtattaattttaatattcaaacaattttattatttttatataaaagattttaaaagaagtgaacgattcaaaactctgaacaaaggtgtttacctgaaaaaaacaattgtattttccggagaaatttattatgatgaaataagtaatttaggagattatataacaattttaagtttgaattttctgattgttatcactgattcatgtgaaggcaagcaggtctgctgttttctcatttatgagtattttgttaggaggaggaagaggagtggcaaataaagaattaaagaggggcctgggcgcgcgccatattcagatgatcgccttgggcggtacaatcggtgttggcttgtttatgggttctgccagcacgatttcatggactggtccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaacggcggagatgcgatcggtttgtcgaacctgtggtctcacgggggcttctttgcaggaggtttctcaggtttcttctttgcactgtctcttgtcattgcggcctatcaaggagttgagctgatcgggattacagcgggtgaagcgaaggacccgcaaaacacgctaagaaatgcgattcaaagtattatctggcgtattttgattttctacattggtgctatttttgtgatcgtgacggtgtatccttgggatgagctcaactcactcggaagtccgtttgtgtctacgttctcgaaaatcggaattacggcagcggccggcattattaactttgtcgtgattactgctgcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtgctgaactatatcgcgccgccgaagatctttgtctatgtatacagcgcaagcgtgctcccagggatgattccttggtttatcattttgatcagccatatcggattcagaaaagcgaagggcgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttaacaaaaagcgaacaagcagctgaataacgataaaaaagagacattcgcggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaaggggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagaatttgtggaagaaatcgaatttgaatttaacggggaatatcccgatcatgatttgattgaagagcttgtgaatcattattgttttgagcatgagatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatctgtcaggcgagttccggttttcccgtagagcgtgtaatgatcgccttcctcttgaatcatcatgcgcttgacggttttcattaccggcttgtcaaatggaagctcctcgttagccagtttctccaaaaaagtttcttgttccagcggagatattgtgagcgagctttgcagccaaaactggtcgattccccgctgatatcctcgttgccgtaagatagagtatgaagccatgttttcattctttcctcgccgatatctctcgctaatgcctgataataccagattgcggattcgcgcatggccgagccaagcgtatggtcgcggttccatgtttcgaattcacgcttgaccccgtcccatcgtttaacatcgtattcatctcttacagctttgacctgcaaaccgattaaagcgttcacgactttaaaggtggattgcggagtttgtctttgatttgcccgttttctgttatagacaaatgtctgatccttttgtaaatcgtgaagaatgaaggttccatccgtatccttgaattcgtcatcgacattcattctgctgacattcaagtgtttttcatgagcagatgatgctgcgtggacggagaagccgccgatccctacaatactcagcacaagcacaacatatatccattttttcattttgttctccccttcgttttgattaactaccttttctctctttcgtttgttcttcctttgaaaaataatcaaaaagtgcttaaatttggttttgtaaacaaatactgttactgggtttatattcggaagataacgtgaaaatagagggtaaaaaggaaggcagggtaagcggatgaatgagcagattccacatgacaaaagtctcgataacagcctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagcgggtgcagaaatcgctgtttggtgttaatgcgattcagggaatggatggcagcgcgcatatccatcggaagatgctttttctatcattaatgacaccgccgcatcaaaaacgtttggctgagttgatgacagaggagtggagagcagcagtcacaagatgggagaaggcagatgaggttgtgttatttgaagaagcaaaagaaatcctatgccgggtagcgtgctattgggcaggtgttccgttgaaggaaacggaagtcaaagagagagcggatgacttcattgatatggtcgatgcgttcggtgctgtgggaccgcggcattggaagggaagaagagcaaggccgcgtgcggaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtattgcggcctattgtcgccatttcttactttctggtgttttcagctttggcgcttcatgagcatccgaagtataaggaatggctgcggtctggaaacagccaggaaagagaaatgtttgtgcaggaggtccgcagatattatccgttcggcccatttttaggggcgcttgtcaaaaaagattttgtatggaataactgtgagtttaagaagggcacatcggtgctgcttgatgtatatggaacgaaccacgaccctcgtctatgggatcatcccgatgaattccggcctgaacgatttgcggagcgggaagaaaatccgtttgatatgattcctcaaggcggggggcacgccgagaaaggccaccgctgtccaggggaaggcattacaattgaagtcatgaaagcgagcctggatttcctcgtccatcagattgaatacgatgttccggaacaatcactgcattacagtctcgccagaatgccgtcattgcctgaaagcggctttgtaatgagcggaattagacgaaaaagttaaattaaaaagctctcttcctttatcgaagagagctttttgattacttctttttttcatcgtagtattggacgggatacatggagccttctgataccattttgttgtcctcgatatcttgcgggtccgggtggccggctttatcaactgggaacgtttccatgtctggctgttttgttattttcatcttcatgctgtgaatgaattctcttgccttttggcgatttgacgggtcctttaatagataagaagtgatgccgacagttgaaacagcgagacctgaaagtaacagcttttgtttcatggtgatactcctttctattttaagaatagtgtttcctgtatcattcccgttttggaaatagctaaacctattgtgtttttatcattggaattcacagtaaattccatttaagaagaaattagtgacttcattcctgtattggaaggtaatatacattgacttattatagtttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctcgggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcgggggaatggtaaaatatacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcatttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttccggtatcgtttttgcgtttaacggtttccaaagcccgattaatatggcgggtgaagcaaaaaatccggggaaatcaattccgattgcggttgttggctctcttttcgttgcaacagtgatttatgtcctgctgcagatcgccttcatcggagcagtgaatccttctgatattgctcacggctggagccatctgaattttaattctccttttgctgatctggcgattgcgctgaatattaactggcttgttattgtgttatatgcggatgcatttgtatcaccgtctggaacggggattacgtatacagcgacaacgtcccgaatgatttacggaatggaaaaaaacaaatatatgccaagtgtattcgggaagcttcatccgatttacggcgttccgcgacaagcaatgttctttaacttgattgtgtcgttcatctttttgttcctgttcagagggtggggtgtattagcggaaattatttccgttgctacgttaatttcttatatcaccggcccgatcacagtgatgacattgagacggacgggaaagacctgtacaggcctcttcgtttaaaaggcttaaacgtgattgcgccgcttggatttatcttcgcgtcactggtgctgtattgggcgcgctggccgttaacagggcaggtcctgtttattatcctgatcggtcttccgatttatttctattatcaggcgaaggcgaaatggaaagggtttggccggaactttaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaatatagaagaaaaccttgcgatagttgtcgcaaggttttttgcttttaataaccctttttactttgtggaaaagatcaggatagttggtgaacactcctgttacgccccaatcaagcaggcgatgcatatcagcttcattattgactgtgtaagggtgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcagttttggctgtaattgatggacttttaccagactttctttgctgaacgattgaatgatcacctggcctggcttagaatgcttccccagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggccgacgtactgcggctttgctttttccggataggcttcattaaaccaagaaccggcgtcaagcttcttaatgtctgcgagcgtatggtctttcacccagcccgttccgtttgtggtacggtccagtttttcatcgtgcatgacaatcaatttcccgtcttttgtcatttgcagatctaattcaatataatctgctttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtctttcatattaaaaaacggatgtaaacggcgtgttggaaaactattaatcttttatgtgtctttcttaaacatgctctgcccgttttcctgtattccacgtcaaagccaagaagacgatggcaagaatgcaggaagagatcagcatgataaagccgccgttccaattaaagcggtcaacgacaaagcccataatggcgtttgcgaaagcggatccgccgatgtatccgaaaaatccggtcaaaccggctgcagttccggctgcttttttcggtgctagatcaatcgcttgcaggccgatcagcataacaggtccgtagattaagaagccaatgctgatcagggcgatattgtctacgagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgcgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggtgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatggagaaccaatgggccatcgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtaatagcctgcgtagccaatgaaaataccaatgaatacttgcagcctgagccgtttgtatgccgcatccatctttgaatcatccagtctctcaatgtgaggagccggtttaaatatattaagcattaacaattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgcagttatgtttttttactagtaacataaaaatctggagggaggctgtttaaaggtggatgaattagatatcgcattctttattttgccgttaggaattatgctgctatcgattgtcgggacctgtatttgtaaaaacccgtatctgatgccaatgcttagtttggtgatttctcttgtgctcacctttaccatttttaatgaatcatttttgggatgggctgttgtctatagcttggtttctctggctttatcctatatcacattgattgtggtaaggaaaaggaaggaatcaggaaattaaaaagacctcactttctaacatatcgttgactaaggcaactatatgtgattataattggcttagtcaacaatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccgggatatgtcagcaggattgtgaagcagtttgaaaaagaagatttgatctataaacagaggagcaaagatgacgcccgccaacattatatttttgtcacagaaacaggaaaaacgatttataaaaagctggaggagaaagccaacgaacaagtagaactgatgctgaaggaaatcaaccaaaaggagcagcacaagcttgccgaggcgatggcagagattgaagcgatcctttcacagtcgctttctgccagagcatcagagatatcgattagagattattttctttcggaggatcttcaactccttattgagaaacaaagacaattttacgcggaggctcacggttgggatgacacgtttttagcttatcttcaggagacatttgacgctgacatcgaaaaaatatggattgcggaaagcggcgggaaatttgccggctctgtcgggttggtcaagcatgatgaaaagacagtccagctcagatggtttctggttgatgcggattttcggggcagggggctcggcacgcaattgctggagcatctggttgcatactgccaagacatgaagtttgaccgcattttcctttggacggtgagtaccatggctgaggctcgtccgctctatgaaaaatttggattcaagataagtgaagtgaaacaagaagcgccattatggggacagcagctgacagaagaacggtgggatttggagctgtcatgaaaagactgcattatgcttgggtcatcgtctccgtcaccttcttgatcttattggcggttcagggggtgcggctgtcgtttggtgcgtttgtggagccgtgggaacggcagttttcaatggatagaagcaccatctcgctgatttcgacgatgagttttattgtttatggcatatcacagcctgtgatcggtcggcttgtggacaaatggggtgcccgggctgttttggcatggagtgcgttactgacaggagtcagcattttcttaacataccttgtgacttcgccttgggagctgtttttgctttacgggctgggtgtctcgcttggagttggcggagcatcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcttgattgtctttccggctgcgctgctgatgctgcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggttttacgaccgtggggctgatggatacccatttgattccgttttctcatgatcatggcttttcaacgacagtcacgagtgctgctgtcagtcttctggcaggctttaatattgctggcatcttgctgtccggaattgtagcggaccggtggagcagccggaaaatcctgtgctttttatatgcggtgcgggcgctgtcgatcgtaattcttatttacagccacgagccctacttgcttttagcctttgcgattctgtttggattagtggactttgcaacggtagcaccgactcaaatactcgccacccagtactttcaaaactactcgatcggcctcatgattggctggctgtcactcgcccatcagatcggatcggcactaggtgcgtatgtgcccggcgtcatctacacggtaacgggtgagtatacactggctttttatttgtcgattggaatgctcgtgcttgcgagcgtaatgaatgtgatgctgagggagccagcggcggttacgcgtgacagtgcggctgtggtagacaagtgatgagagcagaggataagcatctctgatttgggattattcagagatgctttttttgtatttttgttctaatacgaagtcgatcataccgactatgcgggcgttttcggatttttgtttgaagttttgggagacttgaatggcttttgcgtttttaaaacaagaggcaagccagataaacccgacaacaacaaaaaataatctagcaagtaaactccctgcatggggtaattcattagttgtaaaatataaaaatagagtaactaatgtaccgtagattactgtttttatactatgtataagagttagctgaggctcactaaagaatacttttagttgattcagcatgatagaatcctgcttggttagaaaagtcaggatttctttatcattttccttgtactgtttaatagtttcggccatttttactgtctctttaaatgtttgttgatttagagtcatccagtatcctccttaaaagtaaagcactacatgaggaatgatatagatccatagacccatgtagtgctgatatattatttatttgcagaagggaataaagctaaaaacgcacttataaaagctacagctccacctactgctaaggtttcaggtatagctgttagcaaggcagcaattcctaatacagcagccactccaaatgtaatatgagtgagagtagattcccaatctggtgagtatacttcctcagtatctggtaaagtaaagtgcttctgttttattttaaacgtaatcgtagtcgttagtccagttgtgacattgtcacctactggaatatcaggtgtatagattttaatttgaatgtttaaagattcagctgttggatttacataaacctccaaataaccgttgcgtactgataagctcagactatttaaaaggttttgataagagtcgatttgtgacgcagtgagagacgtttgagtgtcgcccaataaacccgtgatataggcacctggtttaccatttgtaatggtaattgtgtttggtgaaccttcacttggtatggttgccagaagtgaagttgatagaataatatccaactcaggtgatgtgaaaatggtttctgtcgtatcaaattcaaacatcgcgtttgccagacttgttagattttctaaagctggaatggtagataaaatgtctgtcagtgtacgcagtcttgcatcatataccggatcagacggcggatttacattgcttgcacctgagtctcttcctgaatacccgtctttatcaatcccgatgcttccagagccgcttccgatggttccttcataaaattgatcaaaggcccaattgtttggcatcggatagccgagattgccgctaaatcctgttgacatatttgccacaaaactatactttgtcattcctgcttctgatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcagcagaagcggcactatatgcatctcttgtgccttggtctttgacaaaataagaagattcatagccgccgtcttgataaattgggaaaaccttcaatccggcatcaagaataactgcaagctctttagatgtcagggcttttgatgtgaggccgctgcttgtccgcacatttccggtcaaatatctgccaaccgttttataaccgttattccgcagtgtttgagctttttctgcggttataattgtagcagtgtcacaagcagaagcggcgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtagggcataaacttgtggtgccgtttccgaaaaatccattggcaacacttgtgctcatgccttcttctttttgcagggcataaataagagctttatttgtatcgcggccatacagtccgtcacaaggcattaacccgatatagtcattgtagtcccgatttaagttttgttgaatctggcgaattcttgaatcaccccagacaccagcttaaaagcgctcatgtctaataaggctttcataattaacgtggtgacaatcccatcctgtgttgtcagtccggcagctttttgaaattcttttaccgcattttctgttttttcgtaaaagacgcctgtaaaaccgccgggattaaagcctttacaccataaagccccttgtaaaataaaattcatgttgcttggttttgaatccggagcttggcgtttaagaggcttaaataaacgctgtgttgtcggcccgaagttatcggctggctctgagatacccaattcaatttgaagcgcccgagtcagaccgtagatcgtatcccacccagttttcccgctttcttctacagggttatacccatgtttgccgctgtacgtatcgttcagccattgctgtgtgattaagaccatttcatcaaccatttcgattcctcctttgttagattgcgttcatttataggtggcaaacgtaggacaaaataaaaaaaatggatgccgttaagcatccattttacttccattctccaacagcttcgctttcggtttcatctccgagatgtagaggcctaaaagcgtaagggcgcctcctagaagagcgatccatgtcatgttttcatgcaggatcaggacggaggcggcgattgtgataaccgggaccatgtatatataagcactggatttgacggctccgagcacgccgactgaataattccaagtggcgaagcacagggccgaagcgccaatccctaagaaaagcatgttgagtatatttgaagcagatgaaaatcggctaaggtcaaaatggaagtcgaacaaaaataaagcgggaaccataaacaataaaccatacaaaaatactctctgtgtcagctcgatgatgtggtgttcgtaagcgcttaattttttcatgaatatcgagtatccgccaaacacgagagcagccccggcagccatgatgtctccgagcggatttagacgcagtacgatattgccgttgaacgtaatcaataaaagcccgatcagtgccgagccaaatccaatgaaaaaagtcagccgcagtttttcgccttcaagcagaaaatgggccagcaccgcagtgatcatcggaataatggacacgatcatgccgacattggatgcgtatgtataggtgagagctatattttctaatagaaagtataaggttacgccaaataaaccagccccggcaaataacagctcctgccgccaattcctgaacggaatcattttgggacggacgaggataagagcgataaagcccatcaaaaaacgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatggctctgatcgctgaatcctgtctgaaatgccgcatcaatcggccttaccccttgttcaaggagttttttcgcttgattaatccggattgtttccatgtagctattaggggtaatgcctttttgttttgtaaatgaacgcaataaatgatacttgctccagcctgttaattcactcaaatcattgagtgtgacattttcggcataatgctcttctaaaaattcacaaaccattttgacttcgtctgatggttctggaacgctgctaaggaacgtgacatctgaataatggcggatcagctcttctaatagatgaagaaacagctcctccttacgcaaagcttgtttttcctcggatatcaaaatatgcaattcctgcaggctggctgtcagctcatggcggaataacacatgctgggagaaataagggagatgcccggagccagtaatctctttcaccgccttctccatgatatccggcataacattgatacaccgataatcaagcgtccggccgtcaatctgttcacagctatgcgtgtcacgggggttaaagaggagaagatcacctggattgatgatatattcttgatcctgacaggccagataccgttgccctttttcaataaatccaatcacataataatcgtgaaagtggttcgggaacttttgcataattcccttgaaacggtaggcttctatatgaaggtgtgggtcaagctgcagtgtgcgggtttcattttgcatgggatgcctcctgtcggtgtggtggttttggattaagtgtagcatgatttagggggatttcttgtatgatgttgctgtttaggaatagagaaagcagaccgttattggtctgctttcgtttaagaatttaaaagatttcattcctcaataataattatcccttttttaataaaaatttatttttcaaatatttcagttataatggtttggaacagataggaggggcaaagatgtatcaatcaaagaaggttttattgttaggttcaggtgagttaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccattattgagaaagaaaatccggatttgattgtgcctgaggtggaggcgatcgcgacggatgaattgctgaagcttgaagaggaaggatttcacgtcatcccgaatgcccgtgcggccaagctgacgatggatcgggaaggcatcagacggcttgcggcggaaacgcttggacttgcgacggctggctatgaatttgcgaatacatatgatgaatttatacaagcggcagcacagatcggttttccttgtgtcgttaaaccattgatgagttcttctggaaaaggccaaagtatctgccgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacggcattttgcgagccgatcggtcatgtgcaaaaggacggggattatatcgaatcatggcagccgcatgatatgacagagcagcaaatagaagaagcgaagcatattgcgaaaacgatcacggatgagcttggcggatacggtctgtttggtgttgagctgttccttgcgaaagatagggtatatttcagtgaggtatctcctcgtccgcatgatacgggtcttgtcacgctggtgacgcaaaatttgtcagaattcgcactgcatgtccgggcgattctgggctttccgattacagaaatcacacagctttctcctggcgccagcaggcccctcaaagcgccggaagaattagcggattacactgttgaaggattggaaaacgcactggcagtcccaaagactcaagtgcgcgtctttggaaagccgataacgaaagccggacgtcgtatggcagttgcgctttctgctgctgatacagttgaaacggcaagagagaatgcaaagaaagcgttggaccagctaattttaaaatagagtttgaacaggccttgtcatggtacaaggcctgtttttttctttctccgtaaaagttttatcataagaatcagaaacccgattataatgtaaaagtcttccatcaatacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtttcgaatactggtaaagaagctgatgctacgaaaaatcaaacgtcaaaagcagaacaggtttccgccccttatgagggaaccggaaaaacaagtaaatcgttatacggcggccaaacggaactggaaaaaaacattcaaaccttacagccttcgagcattatcggaactgatgaacgcaccagaatctccagcactacatcttttccatatagagcaaccgttcaactgtcaatcaagtatcccaacacttcaagcacttatggatgtaccggatttttagtcaatccaaatacagtcgtcacggctggacattgtgtgtacagccaggatcatggatgggcttcgacgataaccgccgcgccgggccgcaatggttcgtcatatccgtacggcacttattcaggcacgatgttttactccgtcaaaggatggacggaaagcaaagacaccaactatgattacggagctattaaattaaacggttctcctggaaacacggttggctggtacggctaccggactacaaacagcagcagtcccgtgggtctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagctattgccattcacacgaacggaggatcgtcatataacttgggaacaagggtgacgaacgatgtattcaacaatattcaatattgggcaaatcaataaatacagcaaactagccatattcatgtctattttgtttttatgcggatgcagttcgcagacgcattcttctcaaaaagaaacgactattcctgtcactcttcatgtggaggatgctaaggggctgccggtcgcaggggttcaagtgacgattgtcaaagcgccctcttcagatgaggagccgagtacagagattggcgagatacttggtaaaacagacaaaaacggagatatcaaatgggataccggcagaaaaggcgattactcagtcgcgttgacgaagggtgaaacatcagtaacccatcagatctcgttaacagaggataaaaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttattttatatcaatcaaacccggaggaaaaagaagaaaatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacgggggccttttcagctctgcgatgtggtatccgaatatcgcggcgttgagccgtcaatttcgtacatatgcggtcgatataataggagacaaaaataaaagtataccatcagcagccatggaaacgagagctgattttgcagaatggatgaaagatgtctttgattctcttggacttgagacggcacacctggccggcctttcgcttggcggctcccatatcgtgaatttcttactccgcgcgcccgaaagagtagagcggacggttgttatgagtcccgctgaagcgtttatttcatttcatccggatgtctataaatacgctgcagagcttacaggggaaaaaggagctgaatcatatatcaagtggatcacaggcaacagttatgatctgcatcctttactgcaaagacaaattgtggcgggcgtggaatggcaggatgagcaaaggagcctgaagccgacagaaaacggctttccgtacgtgttcacagaccaggaattgaaatcgatacaagtcccggtactgctgatgttcggtgagcacgaggtcatgtaccatcagcaaatggcctttgagcgggcttcggtattggtgccgggaattcaggctgaaatcgtaaagaacgccggacatctgttatctctggagcagccagagtacgtcaatcaacgcgtcttgtcctttttatgcgggggataaaatagtaaggaacatgaaaagattggcattcatttttcaaaaggtaacaaatgttgtataataatagaatttgaatgctgctttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggaaagaactggattcgtttgccgatctggttacgtttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacatttatcggtatgccgattccgtttgcgggcatgtgtctcgttattctaagcttcacctataacccgatccttctggcaatcggcacttgcggactttcatatttaatggtgagtaaaataaaattccctcattttaaaaaacatgcggcagaaaacctggagtctgggagatggaattagttcagcaactcatagcggattacggttatctcgctatttttttgatgttggtattagggattgtaggattgccgattccagatgaagtaatgatgaccgttgttggctatttcacgcataccgatgtgttgaattatgagctttcgatattgatcagttttgtcggggctttgttaggtatgctgatcagctacatgattggcagaaaagccggacgcccgtttatcgataagtacggcaagtgggtcggcttaaaagaaaagagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgcggcaatcggcgcctttttgtggtgctttgtttttattacaatcggaagggttatagggattattcatgtttaatacggctgtaaagattctgtatcgatcattgatagagctgacgaatcatcgtctgtcatcctatctgattaaaggattttgcgagtcgaaaatcagcaaaccggtcattccgcttttctcaaaacattttcggctgaattgggatgatgtggacggtacggctgctgattacggatcgctgtccgaattgttcattcgacaaataaatctggagcggcgccctgtgtcaaaagaggcgcatgcggtggtcagccctgttgatggtgtggttcagacggtaggaatcatcaacccgaatcaaacctttacggtgaagggaaaagattactcattcgctgagctgaccggctgtaaaagcgcagaccatcaatacaacggcggttacttcgtcgtgctgtatctaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattatcggtttgtgtacgagctgaatagcggcagccgaaatgtcctgatgattcctgtcggcgcgatgaatattaattctatcgtgcagacgagcacccgtgctgaattggagatcggcgaagagctgggatacttttcatttggctcaaccgtcattttgatttttgaaaaagacgcgttccagccgtccgcccatttagcagaaggccaagaagttcaagtcggagaactgataggttacgaagagtaagaagaggagcttgcataaacgcagcgcctcttttttttgaagaaaggtgagacttatggagaaacaaatcatcagctggattacagattatcagaacaccggagatgaagccgtcctgcggcaagtgcgagaagtgtgctggccgatcgttgaagcggttttgcaagagaaggcaatagatgatgaacaagcgaacaatttgcgcgaaaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagctttttttgttggcaggaaaaggaaactttttctatatctatctcgtaatgactagagaacctagcagaaaaggagagatagaattgaaacgaatgatagtgagaatgaccctgccgctgctgattgtctgtctggcgttttcttctttttcagtctctgcacgtgctgcttctgaagaaaaatattgggattcatggattgaacgacatgcacagccactggatgcttccaatgcttcaaacaaagaccttcgatttctaaagaaggtgctgaaagggaaacgaatcgttcagttaggggaaacgacacacggcgctggtgaaatcaacgccacaaaggtcagaatgatcaaatatctccacgaagagctgggatacgatgtattggcatttgagtctggctttcctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccgctgatccttaccggttttgatattcaaagcatgaagaattcattcaatgatgctgcgactcattgggtaaaagcggtggaccctgagaaagcagagttgctctcccaatcagaaaatgatttttcaacattagtgacagacagcaatacgtttgatgaattttcgcaaaagaaggaaaagcttgtgaaaaactatcagaagctgatcaagttcactaaaacacatgcttcagagctaaaagaaaaccttccaaaagagccgaaagcttatgagatgtttatgcattctcttcagctgagaattgacgtaatggaaacgtatatgctggaagaaatgaaagaaaaactagaggagtatccggagaatattgaggatttttcattctttatgagagaccgcatgatggctgaacaatttcagtgggtagctgacaccctttatccgaaaaagaaaatcattgtctggggccacaattaccatctacgcaaacagaatacgaagatgataaaggactgggtacagctaaacggccctaacatgggtgattatttgccggagcagctgaaaaaacaaacatatacgattggcatttatgcttactcaggtgcgagtcttgatagctccgataataagactgttaagccggttacaagcccgccgccgtctgagagccttgaagctttgctgaaagcggcggaccgaccggctgtttttgttgattttctccatacaaaaaacaagaaaggcacttcgtggatgtataccccccgcacagcactctattggggattcacagaagagcagatgatccttaaggaacaatatgacggtgtcatttggctggagcatatcacgccatctgtcattatcaagtgagcggtgtcccctgtgctataacaggtggagttcaccttttgtttgatagttttcagataactacattgattagtaaatgaatggaaaatacttgtgtgccgtgagaaacccttgtgccgcttaggtttgtaagagcttggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggtcgaacagactgaaaaatatatggaaacaatgaaagctgatcctcgttttgcggacatggtatttaaaattgatgaagcagaaggccatgccttcaaaaaaatcttcgtccgtcataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgcgaattacctgaatggatcgaagaacacaaagatatgcttgaaggcaaaaagattttaacgtactgtacaggcggcgtgcgctgtgaaaagttctcaggatggctggtgaagcaaggctttggagatgtagcacagcttgacggcggaatcgtgacatacggaaaagatccagaggtgcaaggcaagctttgggacggccagtgctacgtatttgatgaaagaatcagcgtgcctgtcaaccgtgtcgagcatgtgattgtcggcaaggactactttacaggagaaccgtgtgagcgttatgtgaactgcgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataaaaaaagaacacctcgtattgaggtgttctttttttctatatgctttcagtttggctgtttgcggaaacccattctttttggcggaaggccttttcccattttgataccacgatacaggcgatcgcatgtcccggtacgttcacgcccgttctcgccatgtccatgacgcggtcaacacccgcgataatggcaacgccttcagccggcagtcctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaactgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagcagccatcagggctaacacgccgataggagcagtgaccatgacgatttgcgtgagcttgaacataatctgagcggtagattcaaagaacttcattactggttcagaagctttgccgataccagcggcggcgacaccaaataaaatggcgaagaaaataacagcaagcaaatcatttctggccatgacatcaataatgtttgtagggataatatccaggatcatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgataccgaggctgcccatttttttcatgcttccgcttcctgcggctccaatgacaatggtagaaaacacaatcggcacaacaatcattttaatcaggcggataaatccatctccgacaggtctcagtgccatcccgaaatcaggaaaaaagtggccgatcaatgcgccgacagccaaagcgattaaaatttgaaacgcgattaattttttcaaatgaatccccctttagaacgatagaatttaggcatattcatatcattcgtgattcaaatgcaaacaccttttttcaagttattttattttgacagcgctttcattatgttggcgaaaaagtcccccgcagcagggggacttttttacttcatttgaatgtgctttagatcttcttcagaggtatttgtgaaaataaccggtgttatggctgaagcggcatgctgcttgatgtaatcgagatcaagggtgagaagcagttcgccttgtttgacggcttgtccgcttgtgacatgtgcttcaaagccttccccattcagtttgacggtatcaacgccgacatgaatcaggatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggataaataaaggtctcaccggaatcgggcttctgcggtttgtcagttaccgtgtccagcgtggcggcggtggcagggacgcctccggccatgattgttttgatgtcgtcttttaaggcatcggacttggttccgaatattgcctggaagttgttgttgacctccagcacacctactgcaccaagccgttttaattcatccttgctgacttggcttggctgatgaacggtcacacgaagccttgtgatacacgcatccaggttagcgatattttgctgtccgcccaaggcctgcagcacgtgaaaggcaagctggtcttttgcaactggagctttctcctcattctgacggtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattccgccgcctgagaacgtatagccgtggcggacatggaataaatcacaaacgacaaagatgacgccggcaagaatagagttaatcaaatagagcacaggcgcaacgaacaagaaagaaaactcaaccggctctgtaattccggtcagcatagatgtgagtgccgcagaaatcatcacgccggagatcatttttttcttttccggacgcgcggtatggataatggcaagagcaactgccggcagacagaaaatcatgtaagggaaatcccccatcataaagcgcccggctgtcgggtctcccgcgaaaaaccttgtcaggtctccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggatcagcggccaaacgaatgagaaaatgacgccgatcaccaatgaactgacggaagtaataatcgggacaaagcgttttccagagaaaaatccaaggaccggatgcagctcgattgatgaaaatcgcttatataaataggcggcgagaagcccgatgatgattcctccgaaaacccccatatcaatcaggtgctcggctccttcatacggaggctgaaggccgagtaattttcccatattgtcgagggtgacggttaaaattaagtatccgatgacagcggcaagtccggctacaccttctccgccggctaatccgatcgcgacccctacggcgaaaatcagcgggagattatcgaatacaacgccgcctgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgttttatgagcatggtgcactctttaatttttgagctgctttataatcggcgataacggttacatgattgtgtttttgaagaatggaggctggtacttctgtcgtgacaggaccttcagccatcttttgaatagcgtctgctttttcctcgccgcttgctaaaagcacaatatgtttgctgaattccatgatggttttaatgcccattgaaatcgcgagtctcggcaccagcaccggatcaccgccgaagaatctggcatttgcctgtatcgtgctttccgagagcttcacaacacgtgtccggtcctcaaaatcagatcccggttcattgaaaccgatatggccattggcgccgatgccgagaatttggacatcaatgcctcccgcctggcggatgagatcctcgtatactttgcatgccgcctcaagctgcggattgtctccttgcgggatatgaatatgatcaggctgcatattgatatgctgaaaaagatgctcatgcataaaatggttataactttgcggatgagatggagagagaccagcatattcatccaaattaaatgtagtaacctttgaaaaatcaatttcgcctgcctgatagtctgaaatcaactgcttatacaagccgaccggtgtgcttcctgttgccaggccgagaacggcatctttcttagcttgtatttgttctttaataatggcagcgcttaacttacagagttcttcgtagtgctcggcgatcagaatcttcatgtgacaccccctcaaagagatagacaagcaccttatttgttatgaccaatttatgatacttgtcattacgaatttagcaccgcccttatcaaactgtcaatattaatttctgaaaatttgttataaaagaaggatacaaatctttcatattgggatggcaaatggtattatggtctcaattaaaaagaacggaatgcatacagaatggggagaatgaaatgacagctttatattctgttatcaagtttaaaatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggcaaaaatacaaacgccgattccgcataagattacgagctttgcagaacaaatgagaggccttcgttctgaatcaaaagtgcttgagcttgtggtgattcctgccgatcactccattgccgagcttttgaaaatgaaagagaatgaacctgtcaacaagcttgtcagagtcagatacgccgaggggaacctttgcagtatcatacctcatatattccctggaaggcggcaccggggctggcacaggaggaatgcaccggctcgctgtttgaattgttaaggacaaaatacaatattgaaatcagcaggggcacggaatcgatcgaaccgattttaacggatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttattgacgaatggaaaagtgctgtggggagcagtgattgctgcattcatcctttcaattgtattttacccttctctgccgacgcagatgccgattcattatgatgttgcgaacagtccgaatctgacggttaacaagctggcggggactgtgatgctgcctgttttgatggtggtgtttgcatgggcgcggaagatcaattggcaattagtgttcgcagtgtatattttgctgatttgccacattgtcgtcctttgtttagcggtctaaatcaaacagccagaataaaactggctgtttttctttaatttcagcttcatctgacaatgaatgtggtgtataatagctgatgatcctaaagaatattctgaaatttataggtgtgaagcggcgtattattaaaggaaaggctgtatactttttgcagctttaaaaagactgaatatttaaacaattatatgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagggtgctgctgttccgtccggatcaaaatatcaaacggctgaacagatcgtgtgagcgcatgagcatgccccctttagacgaagagctggtgcttgaggcattgacgcaattagttgagctggagaaagattgggttccaaaggaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgttgaagatgagtatgtgagggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgtggcctctgcacgcggagaattgacagaggtcttcggcacaggcacggcagccgtcgttacgcctgtcggtgaactcaacattcatggaaaaacggtgattgtaggagacgggcaaatcggggagctatcaaaaaagctgtatgaaacgataacagatattcagcttggcaaggtgaaaggcccgtttaactggacagtggaagtgtgaaaatcgaaaaagaacctgcccggagacaggttctttttattttgaatgagtcatatcagcagccggcaggcttttgcggtttttcacataatacattgcatagcaaatggccataaacggaacaccgcaatacagtgcgattctttgattcggatcaaaggcaatgccaatgacggaagccaggcataacagaaacgctgcaatcggcacgaacggatacaaaggggttctgtatttcaaatcagtaaccttgtttcccgcttcgatataacgttttctgaacatgaattgagaagcagcgatacccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgatgacacctgcatcttgaatcggaatcagccctgacagcacaaaaattgttccgacaaagaagagtgagagacgccagaccgttgttttaatcgcttttggtatcgtcttgtcaggatcaacgctttcaccggctgcgattccgattagttccgttcccgaaaaggcaaaattgacggacagcatcgtcatcaaaatcgggacaaatccatttggaaaaagcccgccttccgcggtgaagttggacagcatcggagcggcttctccgcctttgatcggaatgatgccgaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgtcagccaatacagccaagcgaccgtaaatccggtgcccggccctatgtatttggctgcataggtgtgaaaggcgccggtcacaggcatggcgactgacagctcaccgaggcatagcatgacaaggtagacgatgccggccccgactaagtaggcaagtatcgttccggccgggcctgcttgctgaatggtataaccagagcttaaaaacagcccggttccgatgacacctcccaaggaaagcataaagaggtgccggcttttcatacttctctgaaagtttgtctcattcttgttgtgggcagagttcatctttttccaactttctatcggcgatttatttccttcctaataaaaaatctcatgtcaggaagtgacacgagactccggcgaaccggctttaagttagaatatacaaactattccgataagtcaagttgtttttaaagagcgggcccaagccgcaatttcttgaatatcttcgggttttgtccggcagcagccgccaatcagtctcgcccctttttcatgccaggtgcgggcgctcgccccgtaagattctgcgcatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccacgatgcgcagtcagctgcaggtgttccgtcactgatatgcaggccgtctttagcactgaagctgatccacgcatacgtttcaggaaattccttcaacagctgaacaatcgctttggcttcagtcagacacggaatcgtttcacatgccaaaacatcagctccggcttcaatcagcgccttcatccggggacgatgaaattcaatcagttcatcttctggtattgcgtagttgccgcgatattcagacccgtctgcaagataagcgccataagggcctacagaagccgcaatgatcggttttggccgattcaaacggttctcttcaagcgaccaaaattcatcgcgtgcttcagctgcgatgctgacggacaactcgatgagccggcgtgcttccgcttcgctcagcccgcgtgcggcaaagccttcaaatgtagactgatagctggcggtgattgcacaatcggcgcctgccgcgaaataatcagtatgaacttgtttaatcagctccggctcttccatcaggatttttgccgaccacagactgtcgttcaaatcacagcccttgcgttcaagctcggtcgccatggcgccgtctagcacaataagcgggtatgtatctaatatgtgttggataggattcatagaatgtactgatgccttctttcagatttttttgaaaaagatatgaaaatcgtaatggaggcttacgtgtttgtcaataaacgcaaaaagagaaaggtgttcagcccatatgtctgaacacccttttcttatgatatttgtttgttgtgcgtgtcagtctttgtgtctgaaaccggccagcactcaatgccattgtggtttttgagcacatctttataaaagaccggatccttgcctgcttttttctggcgtgtatagtctttcagcgccgtaaaaacgacctttgatagtaagaaaatcgcgattaaattcacgatgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccaattagagcacagaatccgaataacaaaatcagaatcgcgagaaagcctgatgcccatgatccgacatgggagctgagggaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctgatcaaaaccaaacgcatttttcacgattagcgcaagcacacctggcagctgcgtaatgttggtgaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctggatgctgatccgataatggcgataatccacatccagaagattgcaccgggcccgccgagtgcaatggcgatggcaatgcccgtaatatttcccgttccgacacgggccgccatgctgatgcaaaaggcttgaaacggagaaatggtgtttttcgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcgatacccacgatatgttccaggatttgctgcatagaatcacctcttttttcatatttaaaaaatgctgagctcccactcctgcgccatatgcttcagcagcataccgccagtgaggctgttaccgtattcatcaatggcaggcccgtaaatgccgatgccgcatccggattgaaaaggctgttctcttctggcgcttggaggtaccagcgccatgatgccaccggagacgccgcttttggccggcacgccgacaaacgccgcatatttgcctgaagcgttgtacatgccgcacgtcagcattaatgccttggccaattttgccacatcttttggaatcacctgctcgcgtcgaatcggatgatacccgtcatgagcaaggatcaggccgatcaacgcaatatcttctgtggtgctttccatagcgcattgcttcaagtacacctcaagtgtttcttctacttcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaagaatcgaagcgatggtgagggcgcccgcgttgatcatgggattgaagggctttcccggcttgttgatttcgagccgaatgattgaattaaaggcgtcgcctgtcggctcgacatctacgcggtccagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccgggtttatgtctttctggtgctcttttatcaattctttcatcgaattcctcctcactgatttttttcttaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatactggccctcatgctgattacggtgccgctggccggtgaactgaaattttatcccctcaatgaagaattccgggtcagctttggggcaccggtttttttcttctttttatcgttgttgcggcaagtgcccgctgtgctgccgggttttctgactggagcggctgttttcatctttcgcgtctttctggaattatggggcggaggacacaatgggctgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctaactgtgcaatttctcatttttcatacggttgtcacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaatcctgagactggccggagagattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgacagagctagaaggggatatcacgtttgataatcagcagcggggagtggtgtttgccatcaggctgcctgtccggcatttgattcagaaagggtgaaccaaaagctatgcgtttttttattgcagatgatgaccgtgcggtgcggtcaattttaaggcagatcattgaggacgaagatctcggggaagctgctggtgaagcagacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccattcagcattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcggtacggaagctgggcacaggggcctcacagacggaagtcaatcgcgaaatgaaagcctcggagcagcgtatccgcagagcgattattcattcgctgcaccattttgcttcactgggcacaactgatttttcgaatccaaaatttgaaacctatgcatccaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgacctggctgtttttttgctgcgcagaatcccggccggacagtgatttaccgcttttttataaaatatcagaaaataaagatattgacttattgtttatttgtcttacaattaaacaaaaggatatatgggaaggagcggatgtgaaagaaaaattaataatagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttattgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgatcctgcctccgtatttggtgcatggcgaacaggaggggctgtaccagtatgcgaaaacgattattgaaagcactgacttgaacgcgattctttatcagcgcgataacgccgttctctctgttgaacagatcaaacgtctgaccgaatgtgaacagcttgtcggtgtcaaagacggggtaggaaatatggatttgaatatcaacctcgtctatacgatcggcgaccgcttaggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttaattaaagccggtatggaaatcatgggtttgaatgtaaggaatacagccagaccgcctgtcggcccggttgaaaaagatcattatcagcaattggaagcaattttgaagcaggcggctgatcgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatatggtcaaggtcgaaaaccctgccgatgtgaatgatattgtcggatatgtacagaattcaacagctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagacgcactcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttacaggttcaaatcaagtcggaaaaatcatcgggcaagccgctttagcgaggggagccaagtaccagcttgagatgggcggcaaaaaccctgtcatcgtagctgatgacgctgaccttgaagctgcggccgaagctgtcataacgggggccttccgttcaaccggccagaaatgcaccgcgacaagccgtgtcattgtacaaagcgaaatttatgagcgctttaaagaaaaactgctccagcgcacaaaagatattacaatcggagacagcttaaaagaggatgtctggatgggaccgattgccagcaagaatcagcttgataactgcctgtcatacattgagaaaggcaaacaggagggggcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatggaagaggcgctgaacatcgccaatgatgtgaagttcggattaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaaccgtttttgtgaagccgtaatggtgctggaaagaggcatgcgtctctttcccggctttatcacagccagcatatgattctctactttgaaaaggagaagatactatgaaaaaagactttgcgaatgttacaccggcgggcaaaaaaacgtccgtgcgctggttcatcgtgtttatgctgtttcttgtgacctctattaactacgcggatcgagcgacgctttccatcaccggagattccgtccagcacgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgtcttcgttgtcatgggtattgcaggcattcttctggctgtcatctggctaaaaacggtgtatgaaccgaaaaaacacccaaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtccttgggggcattgtgtcagacatcttactcaaaaaaggccgttcactgacctttgcaagaaaagtgccaatcattgccggcatgctgctgtcttgcagtatgattgtctgtaactacacagattcagcatggctcgtcgttgtcattatgtcgctcgcgtttttcggaaaaggcttcggcgcattgggttgggctgtcgtgtcggacacgtctccgaaagaatgtgcaggattaagcggcggtttgttcaacactttcgggaatattgcctcaattacaacaccgattattatcggatacattgtcaatgccactggatctttcaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagaaaaaagatcgaatattccctcaatttctgaaatgaaggtgattcctgttgcgggacatgacagcatgctgctgaatctaagcggagcacacagcccgttttttacccggaatatcgtaatcttaacagacagcagcggaaatcagggagtcggcgaggtgcctggcggagagcatattcgccgcacactggagctgtcagagccgcttgttgtcggaaaatctatcggtgcgtaccaggcgatattgcaaacggtcagaaagcagtttggcgatcaggacaggggagggcgaggaaaccagacgtttgatttgcgcaccactgtgcacgccgtcaccgcactggaagcggctttgttagatttgcttggaaagtttcttcaggaaccggtcgcggctttgctgggcgaagggaagcagcgtgatgaagtaaaaatgctcggttacctcttttacatcggcgaccgaaatcggacgaccttgccgtatcaaagcgatgagcagtcagattgtgcctggttccgtctgcgccatgaggaagcgctgacgccggaggccattgtgcgtcttgccgaatccgcacaggagcgctatggctttcaggatttcaaattgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccatgcggggatgagaatggctactccgctcgtgaagtaatggctgaattccgccgcgcgacagggcttccgactgcgacaaatatgattgcgactgactggcgggaaatgggtcacgcgattcagctccacgcggtcgatataccgctggctgatccgcatttttggacgatgcaagggtcggtgcgggttgcgcaaatgtgccatgattggggtttgacatggggctcgcactccaacaaccactttgatatttccctagcgatgtttacccatgtagcagcagcggctccggggcggatcacggcgattgatacccattggatctggcaggacgggcagcgattaacgaaacagccttttgagatttcttctggctgtgtcaaggtgccggataagcctggactaggcgtcgatattgatatggaacaagtggaaaaagcgcatgagatctatcggaaaatgaatttaggcggacggaatgacgcgatcccaatgcagtttctgatcagcaactgggaatttgaccggaagcgcccgtgtcttgtgcgataagtttgattgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgcttcgagaggcgctcagttcacttgaaacgctgggtgtcattacgagaaaaacacgagggggcacatatttcaacgataaaatcggcatgcagccgttttccgtcatgcttgccttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatctttatggtgaagcggataaagagttccatcgaattattgcgttaagcgctaataaccccgtcgttgaagggatgattcagtccctgctgattacccatgcgaaaattgacagccaaattccgtacagggagagagatgtaacggtcgaatatcacaaaaaaatctacgacgcccttgccaaaagagatccgtacaaagcacattaccacatgtatgaacatctgaaatttgtccgtgacaaaattctaaaaggaatggatgaaaaataatggtgagcaaccgcagttgaaacgtaagagctgcggtttttttaaaaccaatttagaaaacgcttactaagatatgaggagtgattttcatatggcgatgaacctcaggaagaaccaagccccctttacatcaaagtgcatgaaatagataacactgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagagtgccgcagccgcggccccctcttgaaggctacacgtttgagggataccgaaatgcggatggcagtgcggggacaaaaaatatcctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggtgtggcgatcaatgcgcccgacgctgtcattccgatccgcacgattcaaaatctcgcgaagcatccgaacttcggcggagaagtaatggtcatcggattgggctgtgaaaagctcctcccggaaagaattgcctccgaaaatgatgatgacattctatcgctccaggatcaccgaggttttgcggcgatgatccaatccattttggaaatggcggaggaacggttaatcaggctgaacagcagaacccgggtgtcatgtcctgtttcggatctggttatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatcttcggcggggagacgcagaccgaagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacagggaggggaacaccatatggcctggctgctgcaccggtgctgaaagtatcgactcggcattccttatcagagcattgggctgatttaatcgatatcaatgccggccgaatcgcgacaggagaggccagtattgaagacgtaggctgggaaatcttcaggacgattttggatgtagcaagcggccacaaacaaacgtgggcagaccgttggggccttcataatgatttgtgcttgtttaatcctgctccagtgacttgattcatgtttttatagcgggaagatggaatatgctgtaaaatgaaaatcagcgtataggaaacggaggggttatagcatggcattcattagattccgagtgacacgaattcaatagtgaacaactctcgcctgaatgcgagagaatcgggatgaatccgcctatgtatgagcccttatatggttatcaaaaaagagggtggcgtgcctgcccttttttgtgccttcaagcatcccttctctctactgcaggccggagcatgagaaaggggaaatgggatgacaaaccttaacgaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcatacaccggaattgatcgcctaccccatgttaaaagggacgccggctgctggaattgatttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaatacgcttggcgtatctacgacgctttgggaaagatggcaaaagtggataaatgatgatgcatactggcctggtttttctgcactgatacacggcgatctccacccgccgcatattcttatcgaccaaaatgaacgtgtcacaggacttctggattggacagaagcgaaggttgccgatccagccaaggattttgttctttatcaaaccattttcggggaaaaagaaactgcccgtttacttgaatactataatcaagcaggcggccggatatgggcaaaaatgcaggaacacatttcagagatgcaggcggcgtatccggtggaaatcgccaagctcgctctgcaaacacagcaggaggagcacgttcatatggcgctggaagcactcggtgtaatatcggattaagaattgacttcatttcatgaaccaagtattataaactttacaaataatagaacggaacaacaatcgtgaggaagagcaagtacgcatcagaatggaggttcagagagtcggtggcaggtgtgaaccgatcctcccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggtttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagagcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatacaggcagctgctggctgttccgctgttttggctgatttttttaatataccgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcaccgcgtgtcgtgaccggaaaaggtcctcaattcaggacctcttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggggggatccgtctcaatgcatacgggatgacagctgctggagctgccatgatgctttacacagggatcaaatcggcggctggcatgaatacgccaatggcagcatatccgctttctatgtatggtttgttcgcggtaattgcagtcgttaccacagtgattccatttgtgctaatgcttgagggcataaaacgaatcggggcacagcgagccgccgccatttcaatggcagggcctatcctgacgattttctatggagctttatttctcggtgaacggctcgggcttattcaagtcattggatgcgctgccgtattctttgtcattacgggcatggaatacaggaagctgaaaacaggaaaaaaagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgccttcgacggagaagagggcatccggctgtttcagcagggttcatacgatttggtcctccttgatatcatgctcccgaagctgaacggcatggattttctgaaaatcatccgggaaaaaagcaatataccggtcttaatgatttcggcaaaagacggagaggtggacaaggcattgggactgggctttggggcggatgattatatcgccaaaccgttttcgatgattgagctgacagccagagtaaaagccgcgatacggcgggcgacgcaatattcggcagaggagccggctgtgaataaggtgatccggattcaccagctggcgatagatgtagacaatgtttccgttttgaaaaatggacaaccgctccagctgacgtcaacagaatggcagctgctgtgcttatttgcatcaaatcctaaaaaagtgtttacgaaagaacaaatctaccgttccgtttggaatgaagagtactttgatgatcagaacatcattaacgtacatatgcggcggctcagagagaaaattgaggatgacccctcctcccctcaatatattaaaacgttatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcaggacaaattttgcttcctacagacgatcatgcgctcaaaagcttgcttgttaatatcaatcttatcgttgagaatcgtcagcagatcagcgcccaatttgccaaaacagagcaatccatgaagcggatgctgaccaatatgtctcacgacctgaaaacgccgttaacggtcattctcggttatatcgaagccattcaaagtgacccgaacatgccggacgaagagcgggaaagattgctggggaagctccgccagaaaacaaatgaactcattcagatgatcaactccttttttgatttagcgaaattagaatctgaagataaagagatcccgattaccaaagtacatatgaacgacatatgcaaacgaaatatcctgcactattatgacgctgttcagtcaaaaggctttcaagcagccatcgatatcccggatacgccggtgtatgcgcaggcgaatgaagaggctctggacagaatcctgcaaaacctattgtccaatgcgattcaatatggcgcggccggcaagttaatcgggctgacgctgtcttatgatgaaaggaacatcgccatcaccgtatgggatcgcggaaaagggattagtgaaaccgatcagcagcgggtgtttgagaggctgtacacacttgaagaatccagaaataaagcatttcaaggaagcggactgggtttaaccatcacaaaacggcttacagaaaaaatgggaggcaccatatccgtcaaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcaaagaggtcgtatccaatgtcagcatgcatattaaaaaaggtgaaatctatggctttctcggcccgaacggcgcggggaaaacaaccattatgaaaatgctgacgagccttgtcaaaccgacaagcggtgaaatcatcatccttgggaacaagttcacccacacgtcatatgaggtgctggggaacatcggcagcatgattgaatatccgattttttatgaaaacctgacagctgaagaaaatttagatctgcattgtgaatatatgggatatcacaataaaaaagccatacaagaagtgctggatatggtgaatttaaaacaaatcgacaaaaaacccgtcaaaaccttttccctcgggatgaagcagcgccttggaattgcgcgtgccatcctcacgaagccggacctgctcattttggatgagccggtgaatggtcttgaccctatcggcattaaaaagatcaggcaattgtttcaagtgctgagcaaagagtacgggatgacactgctgatctcaagccacctgctgggtgaaatcgaacaaatcgcggacacaatcggcgtcattcgggacggcaggctgcttgaagaggtatcaatggaggatgtcaggggccagaacactgaatacatcgagcttgttacatcgaatcagacaaaggcctgctttgttcttgagaaagagctgcaattaaccaactttaaaattttaaatgagaaaacaatccgaatttacgaagccgaagcctcacagcctgctatatccaaagcgctgattttaaatgatgtagacattgaatcaatgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatatcagaggtgccctcattgccaacgtgatcattatgggttttatgtggctgatcagttattccgaaaaagccgatggcggggtttcgttccaaagtacggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccaccggtttcttttggctgaactcgatctaccattttataccagtagagcttactttcgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggattgttcttttcctacatggcgatcaggaatgcggacaagcaggatgcgtaaacaaaggcgcccaataagtataaaaggccaatgctgtcagcaccggcctttccattatgagtctgttcttgtttcaagataatgcttcttgccaatctctttgctcatcatatagaaatggaagcaatattcaccgattgccatgacgatcgcgccgaataaagccgccaacgcaacttcaccgccagtcatccccagggaaagcggcatgcccatcagccagatcacaagaaaggccaagccaaaatcagccaaagttgcaatcatattattccatctcggcaatacatacagatcgcccagcaaataagaaataacccctaacactatcgtcattaacagcgtatctccaaacgtgaaaccaaagcccagaccaagcaccagatacaacacaataatcgtcataatacctttaatcgcgagcgctttcacatgtgtcattacaattcctccttttgtcatttgatttgttatgtataattcctcaaatgtaaaaagttaaaccttatttcttttcggaggcgggtgcaaatctgctggggaggggtcgatgatgtgaatcaggaattgaggctgcggcgcttcgacagcggaaacgtgaagcttgtaccgcaccggacgctgctttgacgcccaacagcccattatgttggctgtttttagatgaataaatttaaaaacttctcctgtccctccgtcatcacttctgaagtaatgaaatatgatgaaaagagatcaaggggaggtgacgtgatggcggtcgtgagagcaacgagtgcggatgtcgatctgatggcaaggctgctcagagcggaagcggaaggcgaaggcaagcaggggatgctgcttgtcggcaacgtaggaattaatcggctgcgggcgaattgctcagattttaaaggcctccgcaccatcaggcagatgatttatcagccacacgcgtttgaggctgtgactcatggatatttttatcaaagggcgcgagatagcgagcgtgctcttgcacggcggtcgattaacggtgaaagacgctggccggcaaaatttagtttgtggtacttcaggccggagggagactgtccagcccagtggtataaccagccgtttgtggccagatttaagtcacactgcttttatcagccgacggcggagacgtgtgaaaatgtatataacacattttagagacaggacaccgttcaaattgaacggtgtttttatttgaaaagatgcaatgggaaatattcctgtgagataatcgaagaaaaaagagctgacggagatgacagaatggcaacaattgacctgcaaaagaaaagtgtaaagatcgtactggagaaaaagcagttaacgaaggtgacggctcgtgtcggactggttcttgatattacgggatcgatgagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggatttttcgggctatgtcgatcgtgaaattttaaataatgaccgcttgcataaattcggcagaaatgatgagccgccagtcatgaaggacgtgctgcgcaaatatgttgcggaggaaccgagctcgtatcctgctttcattgtttttatcaatgacgggggctgtaaaaagtcaatcaaaccgataattaaagcttcttctgataaaccggtgttctggcagtttgtcggcatcggaaacggaaactttgattttctcaataaactggatacgttagaagggcgtgtcgttgataacacgaacttcctgcatatcgaagagattgaccgcatttctgatgatgagctttatgatgctctgcttgctgaatttccattttggctaaaagaagcgaaggaaaaagggattgtaagagaacaagagcctcctgctgaaaagccgaaaaagaagggctttttcagcagattgttttcgaaataactgataaggcactgagtcattctgcgaaatggctcggtgtttttgtttttttaagatcatgtgaagaaaaatagtccgaatgggcggcttgcaaacgacaggatatgcagaaaacgcgtcattcagccagctttcggcatgtttcagcggcaggcttgtgagggaagacctgtttttgatgttcagcgcttacaatcggttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgtaaatttattcaaggagcggggaagattgcaggactttctcttggattaacgattgcccagtcggttggggcctttgaagtaaatgccgcgcctaaattctcaagctatccgtttacattaggggtagcgtcaggtgatccgctttccgacagtgtcgtgctttggacacgcctggcaccagatccgctgaatggcgggggaatgccgaagcaagcagtgcctgtcaaatgggaggtcgcaaaggatgagcatttccgtaaaatcgtaagaaaaggcactgaaatggctaaaccgagtcttgcccattccgttcatgtggaagcggacgggcttgagccgaacaaagtgtactattaccgtttcaaaaccggccatgaactaagccctgtcggaaaaacaaaaacactgcctgcccctggcgccaatgtgccgcaaatgacctttgcatttgcttcctgccagcaatatgagcacggatattatacggcctacaagcatatggcaaaggaaaagcttgatctagtcttccatctcggtgattacatatatgaatacggtccaaatgaatatgtatcaaaaacaggcaatgtccgcacgcacaacagcgcggaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggactctgcttggaaaagaacaggagcagtggctcttcaacaatttgggcagctcgacagcccactggaatgtgctggcgcagcagattttctttgccaagtggaatttcgggacaagcgcaagcccgatctacagcatggattcgtgggacggctacccggctcagcgcgaacgggttatcaatttcattaaaagcaaaaatctgaataatgttgtcgtactgacaggtgatgtacacgcaagctgggcatcgaatttgcatgtcgatttcgagaagacaagttcaaaaatattcggagccgaatttgttggaacctcgatcacttccggagggaacggagcggataagcgggcggatacggaccaaattttaaaagaaaatccgcacatcaagttctttaacgactatcgcggatatgtccgctgtacagtgacgcctcaccagtggaaagccgattatcgggtgatgccatttgtgaccgagccgggcgcagccatttccacgcgggcttcattcgtttaccagaaagaccaaaccgggttgagaaaggtatcatccacaacaatccaaggcggggtgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggtttgattctgatcttcgtcatcgccctcattatttttggcccttccaagctgccggaaatcgggcgtgccgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatctgatcgggcatttagaagagcttcgccgccggattatcgtcaccctcgcggcattttttctatttctcatcacggcttttttgttcgtacaggacatttatgactggctgatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcgctgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggcatcttaaatccttacagactggccaaagcgagaaagctttcctattttctgctgattgtcgtgtccatattgattacaccgcctgattttatttctgattttctcgtgatgatcccgcttcttgtcctgtttgaagtgagtgtcaccctatcggcgtttgtctacaaaaagaggctgagggaagaaacagcggcggccgcttagtgcagcgtaccgcccggtgacttcacatcctcatcatattgtgcggccgtaacagcggcgattctcaatgcccggacaatcgtgtccaggctgaggctcggcgctgttttgtcgattgtttgctgcggaatgtaaggaatatgaataaaaccgccgcgaatgtgcggggatgtccggctaatgtgatccattaacccgtagaacaaatagttgcatacaaaggtccccgctgtgtatgaaaccgcagctggaatgccgtgttccttcatcttagcagtcattcgtttcacgggaagccctgtccagtaagcggcgggcccatctggagaaatctcttcatcaatcggctgatgcccttcgttatcggggattcgcgcatctgcaaggttgatcgccactcgttccggtgtaacctgcatccgtcctcctgcttggccgacacaaattacgatatccggctgatgtgtttgaatggcttggcgcagagtgtccagagcggatctaaagacggttggaatttgttccgctgtaataatggcttcttctgtctcgaagccattaagccgtttcgctgcttcccatgatggattgacggtttctttgtcaaaagggtcaaagcctgtgatcagcactttttttctcatcttctcatctcctttttcttttattctattgtttatttatgggtttttcatcaaaataatgtaaaggagtgaatcataatggagcatttgccgcagcagtatcgtcatttattcccaaccttgcagatgcatacgatgcttgccagctgttctcagagcgctttggcagagcctgtatcaagggcgatccaggattatcatgacagcctgctgtatatggggacgaactggaaagaagcaatcgaaaaaacagagtttgcgagaaacgagtttgcaaagctgatcggggctgaaccggatgaagtggcgattgtgccgtcagtttctgatgcgctggtttctgtagcatcgtccttaactgcatttggaaagaagcacgttgtatatacagatatggattttccggcggtgcctcatgtttggcaggcacactccgattataccgtatccgtcattccatcaatagacggtgtgctgccgctcgaacaatatgaaacgcatatttcggatgaaacagtactgacgtgtgttcctcacgttcattatcgtgacggctatgttcaggatataaaagcgattgccgagatttctcagagaaagggctctttattgtttgtagatgcttatcaatcagccgggcatattcccattgatgtgaaggaatggggcgtagatatgctggcggcaggcacccggaagtatttgctcggcataccgggtgtggcgtttctttatgtgagaaaggagctggctgacgcactgaaaccgaaagcatcagcttggttcggcagagagaacggatttgatggggcttatgcgaaaggcgcgcgtcgttttcaaacgggcaccccagcttttatcagcgtatccgcagctgtagcggctttatcgctgctgaattatattggggtttctcatatccgggatcatgtgaaaacgatctgtgtcgatgcagttcaatatgccgctgaaaaaggcctgaagctggcggcgggacaagaggggattcagccgggcatggttgcgatccgggatgagcgggcatcggaaacggcggcgttgctgaagaagaaaaaagtgatttgcgcgccgcgggaaaatgttatccgtctcgctccccatttttataatacgaaggaggaaatgcggcacgcgattgatgaaatcgcggcgaaaacgatccacaagtaaacataaaaaaagcccctgaacattagtcaggggcttttcatattaatgatctaccttcacgcgcttcataaagaaagcgccaattaaaccgataatggcaacaatcattgcaaacacaaatgcgtgctgtacacccgctgtcaaagcttgcgggatgactgccggatcggcagggtttttaactgtactcatataatcatgctggcctgcagccataatgctgaccgcaaccgctgttccgatagcgccggccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgtgacatttgagaagaaccatagtacaacggtgacaatcacaaatcccggaatgacaagccatttcggcccgtatttatcgaacaagcggcctgtaacaggggacataaatccatttaaaataccgcccggcaagagaacaagaccagatgcaaatgcagtgaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagcgacacgataacagtcgggctggaccatcccccggagccttcacccgcgttgctgaatccgaacacaatgccgccgaagccaatcgtcgacaggatgatagacaatacatcgattttcggctttgtcgtttcagatacattctgcatgtatgcgataccgaacacaagcgccagtacaaggaacggaagagagatccagaaaatccagtgccagttgagatgctccagaaccaatcccgagaaagttgggccgatggcgggcgcgaacataatgacaagaccgattgttcccattgcggcaccccgtttatgaggcgggaaaatcaccaagattgtgttaaacattaggggcagtaaaagaccggttccaagtgcctgaacgatccttgccgctaataaaaacgagaagctcggcgcaagcgccgcaatgaatgtacctaaaattgaaaagataagtgacacggtaaaaagctgtcttgttgtgaaccactgcaacagcagtcctgaaacaggaacaaggataccgagtacaagcaggtagcccgtcgttaaccattggacggttgccgctgtaatgttcaattccttcataaggtcggttaacgcaatattcagcgctgtttcactgaacatgccgataaaaccggccaacagcaaggaaatcataatcggcatcactttgtattgctgagatgctttagctgttgtttccaaaatcatttcccctctctatcaactgcatgtagtatgtcgtttttttatctcttcagcaggtcaggaatgcagctggagatatgaaggagcggcgtactgttttttgccgtcaaagataaaaggatgccgccttcaatcatcgcgttaaccacagtgctggcttcttttgcacggctctcgctgcagccagtctgccgcagtttttcctcatacacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtataggcttccatgcagtccgcgattttctgacggatatactccttcatctcattcacggcttcgatcgcaagctgttctttacccccgggaaagtggtagtaaagagagcctttaggcgcgccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatgttcaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaaggtctgccaaacattagaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcggcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatctcaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagatgaaatgggctttgtcggaacaattgccgatgatatctattttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacctgctggcatcgaactctttaaacccccaaaagcacggatgttgctgatgcttgcgcttaccaaaacaaatgatcctcaaaaaatccaagcttatttcaatgagtattgaagaaaagaaggcgaataagccttcttttttttggctttttaggaccaataatgacctatgaatcttaaaatttctttaaaaataagccaaaattaccctttacttaattaatttggtaacgtaatatatttggagaatttgttacaaaaaaaggaggatattatgaaatttgtaaaaagaaggatcattgcacttgtaacaattttgatgctgtctgttacatcgctgtttgcgttgcagccgtcagcaaaagccgctgaacacaatccagtcgttatggttcacggtattggcggggcatcattcaattttgcgggaattaagagctatctcgtatctcagggctggtcgcgggacaagctgtatgcggttgatttttgggacaagacaggcacaaattataacaatggaccggtattatcacgatttgtgcaaaaggttttagatgaaacgggtgcgaaaaaagtggatattgtcgctcacagcatggggggcgcgaacacactttactacataaaaaatctggacggcggaaataaaattgcaaacgtcgtaacgcttggcggcgccaaccgtttgacgacaggcaaggcgcttccgggaacagatccaaatcaaaagattttatacacatccatttacagcagtgccgatatgattgtcatgaattacttatcaagattagatggtgctagaaacgttcaaatccatggcgttggacacatcggtttattgatgagcagccaagtcaacagcctgatcaaagaagggctgaacggcgggggccagaatacgaattaatgaaaaacaaaaccttgaagaattctattcttcaaggttattctgctttcagcacaatggttttcgcagccatatcatgaacggtttgttttttcttcgtaaatgcggcagtcaaatagatcaggcgggagaacacatgcacccacgctatcaggtaacggacaatggcttgtgggaaggttatttttttatatgtttcgtccctcacgatttgcagcccgatgatttttttgcccagtgtgcccttccaatttgtcagcggcatcagcaaagggtacacaatcagcatcgatatggcgacaataatgacaccggcggacccatcaccaaacgtaaatccggctgccaaaatcactgctgcggcaatgattacatcaagtaaaagagcgcaggcgcgcagcatgaaaccagctagttccaatagaaacactccttaaaatgttaaataaatacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgaatttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtcattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggacggcaaaacgccggaggacttcatgaagcaggaattcaacaacgttctgttcgcgttgttagctgagaaagatgaagagccacaagcagagaaagcggaagtaagcactgttgagtgggcaaatgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgcggcggcagttgaatattatgtaaacgcgatttctcttaacggcgcgtccgtttctcaagctaaactggcgaaaaaatacggcgtcagcgcatcaacgatttccagccgttacaaagaaattgaaagcacgctgcaagatgaagcagatcgttttgcacaagcgttatcctcataatgaaaaaaaccttgaaaagccaggcttttcaaggtttttttatttctgaaacggaattttgatttctaaccggaagacggggtggcggtaggtaaaatccagcctgccaaaagcgcccttcaccagtttttgaatgatatatgtgcccatgccttcatgagcgccgtttttcgttgagcagccaaacgattgatagattgtatcgagcacttttgggtccatcccggagtgctgttttcacaagtcagtacataaagtccgctgcgcagtgaagtctcgagtttaatctctgctttttctcgggcctccgccgcgctgtcgagcgcattttctaatatgttgccgaccaagctgacctgatcagcaggcgaaaatggaagggaagaaagcggtgtatgcatatgcagcgaaacactcacattcgaggcgcgggctttttctaaaaaatcataaagcacccctgcaacgtacgcgttctctcctttcaaaaaacggtcatattgactgtattgatccgcccagttttgaatatatgcttgtgtatctgccttgggctgagctgatttgattgcagtgatatgtttcattgtgtcatgattccggcttctcacatcaatcagcatttgattggcgtgctgttcagcttgagtcagcttatcaatttgatcagaaagccttgcctgcaaagcagactgtccgatacggagcccttcacaccctgcaaatattacgattacacataatgcctgcatgatgtctgtgccgatcagcaccactcccgccgacatcacttgaatcacggcaatccatgcacaaagccctgaggaacagtgattccacacccgctttgtattccaaatgtacaatcctgcagcagctgcgcctaaaacagcggtgagccaagaggcggctgtgctatgtgaaaaagcagcagctccctgataacatatgaaactaaataaaaccagataaagacattgaaaaagggtaatcacgttctgaactcctcaaaagtagtagttttgaaaataatcaagctgctgcttggtgatcatcgcttttttagacgttccctcaaaggaaactgtgaatgaatgcttggtataagcggaaaaatgctttatgtaatgaatgttgataataaaggaacgatgcgaacgaagaaaatctttttcgggcaggtcgcctttaatatcatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtagcggtcgaaggaagcggccagacgctcggcatagtacggcttcataatataatcatggacgttcaggtcaaaggcgtgaaccgcataaccgccgtggccggtaacaaaaatcacatccacatcaagtgaatgggatttgatcaaatcagcaagctcgtagccagatatatggggcatctcgatatcggcaagcagcagatcaatgtctccattctttacccgcctgtaggcttcctccgctgaatcggtggaaaagacaatttcgacgtcctgcattctggtcacgatcgcttccagcttctctaaatctactcgataatcatctacaagtccgacttttaccattatcattcccctagttacatagaatcatctttattctatcccatttcgcgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagcttaacaattgaaaaaggagaagtcgtcggcattctcggagaaaacggtgccggcaaaaccacgatgctgagaatgattgcttccttgcttgaaccatcacagggtgtaatcacagtagacggctttgacacggtcaagcagccggctgaggtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgattttactcacaattttagtgccgatgattatgatgcttggacttgtcttcttttatgaaagcatgctgtccgacaaaggggagcagtacacgctggctgtcggccattcgcttccgcccgcactggaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaagattgatgtttacggtaattcaatcgatcaagggtcgtcaaatgccatgcagcttgtgcagtctgccttagatcagtacaaaaatgaaattgtgcagcaacgtttaacaaataagcatattgatcaatcggtgatccagccgtttacgattcagcaaaaggaagcggatgaggagaaagggacttccgctattatgctttccgccattctgcccatgctgattctgacttccattgtttccggcgcaatgccgatcgctcttgatatcatggccggtgaaaaggaccggaagtcaatcgaggcgctgctattaacgccagtcagcagaaacaaagtgctggtcggcaagtggcttgcggtttccacttttgccgtggcttcaggtgtattggctttggtgtttttgattttgtccaccgtgttatttaccgaaaatttaaaaacggccttccagctgggagatcatatgtggagtgtaatcggcgcttcagccttaatcattgtgctctctgcattgctgatctctgcgatggagcttttcatcagcatcatgtccagctcggtaaaagaagcgcaaagttatatgtctctcgtcgtctttctgcctgtgttcccgatgtttttcatcttcagcaaggcaccgaaccaatttgacttatcatactttctcatcccgtttctgaacctgcatgcgttatttaaacagcttttattcgggatgattgacccggctgccattatgtctacggcgggaaccatcgccgtgctgatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctggaggtgaagcggatcggattcggcgcgaatgcggtcggcgggcataatctatttccaaatctaaatgatgaaacagggaaggatttagtgcgcacggcattggatggcggcgtcaactttatcgataccgcctttatatatggattggggcgatctgaagaattaatcggcgaagtcgtacaggaacgcggcgtgcggaatgagctcatcatcgccaccaaaggagctcataaagaagtgaacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcgatcggcgcttcgaacctcgattatcagcaattgcaggattttaatgctgatggctatttggaggtcttccaggccgaatattctctcatacagcgtgatgccgagaaagagcttcttccatactgtgaaaaacaaggtatctcctttattccttactttccgcttgcgtccggactgctgacaggaaaattcacgcaagacacagtctttgatgatttcagaaaggataaacctcaatttcagggtgaaacgtttatccacaatctcaaaaaagtagataagctgaaagcagtagcagaggaaaaacaagcggatacggcacatgtcgccttggcgtggctgttaacgagaccggcgattgatgccattattccaggagctaaacgacctgagcaattacaggataacctgaaaaccttgaacattgaactgaccgaagatgaagtgaatttcatcagcgacattttcaaataaaaaggaaatagccgtcaaggctatttccttttggtgttttattctttgatgaatgcttcgactaattctgctgctctgtaatcatccatatcaagctgccattggtcgatgtcatttttcttcatttttacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgtggcttcaacaattgcttcgtctttagagattgaagtcgtttttgcttgaatggaagagtttttgcttaatccctctttaatgccgttcacgatattatcaagcgctttgctgtccgcatatgtgctggaaaggccggaagctgagagataaccgtctttggctgattcattgaaatcatttacaatttcatttttgttagcgccggtgattttttcgaaatcggcgttatctttgccgaaaagaaggacatcaacataagctgataacgcttttgcagaatcttggagcttatctgccgtcgccaggatttttttgtcttttccgtcaattttaaaagtaactgattttggctttttatcaccgtaagattccggcgtatagttgagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagtgtgtaagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaagggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttgaagggaacataagaaggatgaaaggggctgcctttgtgaagaaaaaggaactgaaacaaaaagcattggaaatcggccgggtgccgacacacttaaaactggaaattgaagattatggcggtgatgataaaagagctcatttttgttgggcagatcctcaggatgagaatatcggcattatcgtggaacttggaccggacggggagctggaatccctttcccgtgatattgagcctgaaagcggagaaaggctgtctgaggagaaactagaggatatcatgcgccaatttgtcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagattgtttacttccgttattacggcgaagcgggcagcatcatcaagccaaagcgggtcgcggatgttgaagaggcacttgcctttatcaagaaggacgtggagttcgaccttttgtttcaggttctccatcgttctgtttacaaaaacggagatgatcagccgcatttggtgtacgagcctgaatgtagggcgattaccgtacctgcggatttggttcaagaagaacaagcagttgatgatgacgatgattacagggagccggagagctttcctctccctttattcgagggcatccgcgaaaaggccgatcctgacagcatgattggtattgaaaaagggtttgtcaaagagcgggaagcggatttgggaaatgggagaatcggaatcgtttggcggaatccggatgaccctgtttatcagccggcggataaaagcatggacagctggtttaagggacggactcatcaagtgctgaaaaccatctatcacaaagaaaccggaaaactcgaaggcgtcatgtcatttatggagaaaaaagggccgctgacagtaactgaggcagagtgcgaaaaaatagcgcttcgctttctgtttgctttatttccgaatgccgatcaatattttaggatcagatacgatgaaaaggatgaagaagaaaacgcagtcgctggttttacgtttgaagcgcattgtcacggagttccgatccgatttgggcagatcagaatttgtgtcagccgccagacaggggatatcaccgtttatatgggaccggatattgacccaaataagctggcagccattgatcccattccggccatttcagttgaacaagccaagtctatcttttggcagcattttaaagttgagcttggctgggaaagagagtacggagatgatgaagaacacagctaccggctcgtctataagccggtgtatccgcgttttatcgatgcacatacaggagagcctgtcttcagctcatggtaaaacagccaaaagtcacgcaattacctcaggtatagaagagagtacgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaataaacagctgaaaaagaaggcgcaggagatcggaaatgtaccgacacattatgagcttgagatagaagattacgaccaaaagcaaaagaagaacgggcaggcatattttatctggaaggaccctaaagatccggaaaagcacattacagttgaacttagaaatgacggcgctttgctcaccttttcaacaactgtccgctccgagacagacaaacaacttccagatgccgagctgaagctgacggctcttcagtttgccgctgccaatcatcccggcacatttatgaattttcattttcaaggcaaggaagaacgggggcagcacatccggtttgtctataccaaaatggagctggggcttccgattcccaattcaggctttttaattgatatgacacgaagcggtcagattgtccactttctatattacggggaagggtataaagccgaagttccgacggaatttgtagcaaaagagaaggttgtgtcccattacttaaacacaatgtcttttgagctgatgtacgatgtcattgatggcgagcaggaaccaaggcttgtttatgaaccgattctcccgggatacagctatcccgcagatgtagacgaaattgtgcccgaccagcatatcacagatgaaagaatagaaaacacggcgccactgccgccgcttcagaacaaggaagaagttgatatatttgccttgctgggttttacctctgatatgcagaaagtcagtgaaagagactttggggaacaaattggaagcacgtggcgcagaggcgctgcgccggagcgtaaggatttaagcataggaagctattttgaaacgagaaataaaaacacaatcaaaatgaagacggataaaagaacaggaaaattaaaagcagcgctttcttttatggagcggctgaacaaccgccaacgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcgagagaagcgtttttagccgcttttgatgtgaagctggaatggcagcctgactttactgcaggcagagaccagcactacaaacttgtctataagccggtttacccttcctatattgatgcgcacataaggaaaaagaaaaggctgtgaggggtgtctagttaggaatcatctccaagtgggggtagtccttgaatcgtttccaatccccgccccattcaaaaccgagtgtcttagcgatctcgacaacctccagccaatctgattttccgttttgattgccgtcatattccatatcccatatgatgcttccatcctttttttgaagggcgaaatcaatcgctaaaccatagttatgatacgattcccctcctcttgcataggtgacaatattccctttttttgtacgaccctgtttatataattcatcttgttccttaaaggacctgaatccttcagtaatgacgacggtaatgcctttattcgctgcagcgcctttgagtgcatcggcattctgcttcacaatcggatgaagatccgaggggacaggcatgtcctgcagggcgttttgagaatgccattcatgccgaatataactaaaacaaagatctagaagaaatagaatacataagatgacaaatgtttttgcgggtaacttcatatcggtctcactttctcaagatgtgctgaatgttagcgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttattggaatactacttttattatttcagaggaatgtacgaattcaagcagaaaaatttcatattagcgatcgaccattataaacatgccgaggagaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagatcatgccaggcagcttgaagaagcatacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaggcagtagaggcgtatgaccgcgggataaagagcgcggctgaatgggaggatgacatgtacttgacgaaattccgcctcattcatgagctgtatcttggaagcggcgacctgaacgtgcttacagaatgctttgacctgctggaatccaggcagcttcttgccgacgccgaagatctgctgcatgatacagcggaacgtttcaatcagctggaacattacgagtccgccgctttcttttaccgcaggctgatgaatattaaaaagaagcttgctgagcagcgttttcaataggaaatggcagagaactacaggttctctgctttttttgtgctgttttcaactcggaaaaacagggtattttccactgcatagtgagaaacagaggaggatatcaagtatgtacaaagatttaaccggaaaaacagcgattgtgacagggtcttcaaaaggaatcgggaaagccattgcggaacggttcggacaggagaaaatgaatgttgttgtaaattaccacagcgacccgtctggagccgatgaaactctggaaatcattaagcagaacggagggaaagccgtcgcagttgaggcggacgtgtcaaaagaagaggggattcaggcgctcttggacacagccttagagcatttcggcacgctcgatgtgatggtaaacaactccggttttaacggtgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtcaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcggcttggctcgtatctgaggaagcaagctatgtgaccggcacaacacttttcgtcgatggcgggatgacactttatccgtctcagcttgaatagaacacaaaacagggggattgcgggatgaaaacagactggtggaaggatgcagtggtgtaccaaatttacccgagaagctttcaggacagcaatcgagacggaattggggatttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgcagctattattattggcgtcccggcacaaagaacggcccgccgacggactggctctcaaactatgggtgcccggtctggcaatacgaggagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatgacagatgaagtgttttcccaatatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagcccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtactttattttatgaagggcacgccgtatatttatcagggagaagaaatcgggatgacaaacgcgccgtttacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaatttattacaaaaagctgatcagcctgagaaagcagtacgctgacctcgtgaaagggagctttgatcttttgcttccggacgatccgcagttgtttgtatacatgagagaaaacagtaaacagcagcttttgtcggtcaataatttttcaaaagagcaagctgtttttcagtggcctaagaactgcggcaaagctcaggcctctctgcttctcagcaattataacaacaatgatcttgctgacgaaatggtgttccggccttatgagagcagggtctatcttctggacaaaacaaactaatgattgaagtagcccggcattcttagccgggtttttttagtacatatatccgctctgcaggcgggaagaataaatgaaaatgaaatttattcttgcaaaacgtaatgacttcggtttattatgatataggattacaaaatcgttatcattttgatttaaagttactgaaaaagaggggatatacgatatgtctaaaaaatggagcggtttgtttgtgattgcagcgtgctttttattagttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgccaacattcaggatgctgatttgttcgtttataatagtgaatacatggagacatgggttccgtcagctgaaaaaagcatgggccaaggccatgccgttttcgttaatgcaagcaaaggcattgatttaatggaaggctctgaagaagaacacgaagagcatgatcatggggagcatgagcacagtcatgcaatggatcctcacgtatggctcagccctgttctggcacagaaggaagttaaaaatattacggcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagtcatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggaggggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgtcatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcctgctttattttattgtactgagaaggccgctctacctgctgacgtttgatgaagctacagccaaaacatcgggaatcaatacaaacgttctctcgttgtcattcagtattgtcacaggccttgcgatttcagtcattattccgatcatcggggtccttcttgtatcggccctgctcgtattgccggcagccttcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaattcggcaaggcgctcataagattcttttttcgcctcaaaatcaaacacattgcacagaaccatgatttcatttgtttcgtagcagcctgtgaggtctaacagctgttgtttgacagtggtgggagaaccgatcaccatccgctttctgttttcttctatgagttttttatcggacgctgtatagggatgagctttcgcttcctcgatgcttggcacgcggctgtccaagccttttccgacgcgaagaagccacagatcctggcttaatgcgagttcttctgcctcttcatctgtttttgcgcaaatgacaaaaatcgtaaacagtgcggatggattcgaaaaatgggctgagggccgaaagctttcccggtagatgcggaatgcattttctcctcgctcgggattaatgaaatgcccaaatacatatccaatcccctggtgcgccgcgcgtcttgcgctgttttcaccaagaccgagcacccatagctcgggtgccgtgtcaataaggggcgccgctttgattccggcatacggatggtcgggaggaagggaatctgttagaaaataagagacatcctgcagctgtctgttaaattcggttaagctttttttcaccccgtccgttaatgcaagtctggtttttgtcgtgccgccggggagcgaccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactcttcgctaaatcgagcaagctcaaccgaatgctgaagagttgtcacagggctctctcctttagaaacaggtgcctgatcaagtatgcttaaatgaatcaaaaggccgcttcctttctgtctgtttttagatggtgacacaagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggcggaggattcttcagcaaactgcttggcggaggcggtccgaatatcgactgtgacgcttcagtgctgatgctggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaaatgcctggaaacatcgataagcttgtatttgtagtgaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcgattggtgaaggcacaaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcgggcacgactttgatcttgactcaagtgtgtttctgttagacgctgcaggcaaatgcgcgtcaccaaacgactttattttctacaaccaacttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctccgcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgacaaaagcggtgatcggcttaggctgggatacaaacaagtactccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatccctgctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggcgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtgggggaagttctgactgatcctgtttcctggggtttgatcggttcccttgttgttctggaaggtcttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggataggcgaaaaagaagaggaagcggacggcatgaagaaaaactcttggatggtccgtacgttcgggatcttctgggcgactgtcatttcagtagaattaatggatcttgccttctctgtggacagcatcctggccgcgtttgcagtatctgaaaaagtatgggtgcttctgattggcggtatgcttggtattttaatgatgcgtacagtggcaaaagtgttccttgtgctgattgataaaattcctgagctggaaaacacagcattcgtcttaatcggcattatcgcgctgaaaatggcggggagcgctttccattacgaaatgccgcactctgtattcttcatcatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggacagatattgggcacgcctattgatgagacggactactataacgagctgtatgagctgtctgtaaacgaccgcataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccttgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctagtcggctgtgatgtactactgttccatccggcgggaacggatcagctggcgcttgtcgacccgaagcaggagctcagttttacggaaaagctcccggatgtttcggagcttcagccgtttccgaaagaaaaacctgaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagcagataaatattccattgagattccgaatgtattcgccaaaattatgggcgtgtcgaaagacaataaggaatattggaacaggcttcatactctagcggattatcaggaaacagaaatggtaagaagctttccatttacagaagaaataaagtcgaactatcaatttcactacagccacgcacttgatcaagaagggaacattgatccggacaagctgatggcaagcaatgtgtggcagtacaaacagctgccggcaggcgttcagactgccattgccaaaacgatttcgagaatgtgcaggcacccgcggcttaaggctttgcatcaggaacaagtcaaggatgttcaaatctatttgtttaaacaaacaacaaacctgcctgctaatctgctgaaattgattcaaatgttcgactatgcgcaaaccgttccgaaactcgttttatatcatacggaaatgagcggcggactcgcgcgttcggatgctgccgccctgctgttcctgaatgaaatcggaatcgatatcatcatttataatccgcccggacaccaagatattgagcagtttattgaagaggaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagctccgtcaggaaccagaagtgaagcggcttgctcaacaaattgacgtcaaaaaccaaatggagctgcttgagtacggcaaggagccggccgttgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaaaatttttaaacgcggcggcagcatgattgaaaaaatctttaaaaagtatcagacacttggcggagagattgaaaaaatccacgttgagatttcaaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcggaaaccagctggcgcaaatgcagctcgatacattgcgcaacggcattcaggcgcttgaggaacgggtgtatgatcttgacatggcacggatggtggcgcttcaaaccgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgccagaatggccggcagaccgagcatagatattgaaacgatcgaatcgtcttggaacacgattgtcagcggcatgcaggaaacaaaacaaatcgaagaagaaaacaagcgcctccgcgaagacggcgcgagacgaattgcccagcttcaggataatattaaaaaagcagcattgcagcaataataaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgtttatcatcacccttttatgcttttccatcggaagcggcatttccgcttttgtgacaagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagcttcggctggcaggctgcacttctgttaactgcgctgactgctttttatgcgctgtacctgcggacgagtctgcctgattcgccgaaatatgaatcgctttctgccaaaaagaggtcggtgtgggagaatgtaaaaagcatctgggcaagacagtatatacggccgaccgtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctacctggctatttctctgccgcatggctgattgaaaaagcgggccggaagtggatacttgtcatttacttgattggcacagcaggaagcgcctatttcttcggaacagcggattccttaagtcttctgcttacggctggcatgctgttatcgtttttcaatctcggtgcatggggcgtgctgtatgcttataccccggagcaatacccgactgcgattcgggcaacaggttcaggaacgacagcagcgtttggaagaatcggcggcatcttcgggcctttgctcgtcggaactctggcagcccgtcatatttcgttttcggtcatcttttcaatcttttgcattgcaatcttactcgcggttgcttgtattttgattatggggaaagaaacgaaacaaactgagctagaataggaaaagcacctcttgaaagaggtgctttcagcgtgtcgacaaaccctcgcattcgttgtcaggactgcgcttcggtgctcaatgcgatgtggatcaacggctaaattctcaggcgtcctgcctaaacgccgtcgtcatcacatcctgtgaatgtccgctcctatgctcgtccttcctagacttcaagggttttcaatcacgctgaaaagatgacaaaatcctaaaatgaaaaccattttaggattttgtcaacaatctgaggcacctcttgaatgaggtgctatttttacatttgcgcccgggctgcggattggcgtttcccggttttagtgattgcctggtagagcgtcatagaaagtatgaacaaaatggcagtaaatcctgtgacagctccgaaatgctgtgtgctttgatataaaaaacctgcaatacttgtaccgacagtggtcccggcatacatagcggcattggaaagggaagcgatggttcctcgcgcatttggtgcaatggattgaaagacacccatcattaacggaaagatgatgccagctgtaaagaacgtgagaaaaaagccggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgaagcgaagtttccggtttgaaacagaaaataggcaagcagaatgaccgatgttttcggcaatgaaaaaagctcccgataggggttgacaattgatgggcgcgccaatggttcagaaggccggatatcaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaagggtggacaatgactgggatggacgcccaaatttgaggcgtcacaaacgcagcgctaacgcctgcggcaaaacggaacaggcacatggcggcaaaagagggagcgatgccgcataaaaacgtggatacgataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaattttatcactcctattgttttataactttgaaactatgaaacagatatgtatagagaaaaccctttgttagagggtttccaaaaagccaggcaggtatgtgtgaaaggtgtcttcacgcagactgacgtattttgtccgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataattgatgttgaaaaagcaacttatttttccagtaaaggagagggaagtcataagaggaagaaggaattcaattccaataaaagcgttttcaaataaagataggcgaaaaatcacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggtgttaatcaggcagattttgaagtatatgatggtgagatatttgtcatcatgggtctatcagggagcggtaaatcaactttagtacggatgttaaaccggcttattgaaccgactgccggaaatatttacattgatggtgacatgataacaaatatgtctaaagaccagctccgggaagtccgccggaagaaaatcagcatggtcttccaaaagttcgctctgttcccgcacagaacgatacttgaaaacacagaatacggactggaacttcaaggtgtagacaaacaagagcggcagcaaaaagcgcttgagtctcttaagctcgtcgggctcgaaggatttgaacaccaatatccagaccagctttccggcgggatgcagcagcgtgtcggccttgcccgcgcgttgacaaatgatccggacatccttctgatggacgaagcgttcagtgcgcttgatccactgattcgtaaagatatgcaggatgagcttcttgatcttcacgataatgtcggaaaaacaattatctttattacgcatgacttggacgaagcgttgcggatcggcgacagaattgtcctaatgaaggacggcaatatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgtcgtaagaggcgcgctgattggcgcacttgccggcaataacgagtatatcaacgctgaaggcactggcgaacaaacacaagatccttctgtacaggaggtgaagtaagatggatagactgcctagaatacctttagcagatatcattgaccgttttgttgactggattacgatgacgtttggcggattcttcgacggaattgcaaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgttttgacatctgtgattatttcgattgtggtcggggttccgattggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatctgattgaagcgactgaggcattcggttctacaacagctcagcgtttgtttaaagttcagcttccgcttgcaacaaaaacgattttggccggaattaaccagagcatcatgcttgcgttatcaatggttgttatcgccgcaatggtcggtgcaccgggacttggttctgaagtatatagtgccgttacacagctgaaaaccggggtcggagtagaggccggtatcgccatcgttatcgttgccattaccttggaccgtattactcaaaatattaaagtgaagaagaaaagcagggggaatgcctgatgcttaaaaaaatcatcggcatcggcgtttcctccatgctggcgctctcacttgcggcttgcggttcagaaaacgatgaaaatgcatccgcagcagaacaggtgaataagaccatcatcgggattgaccccggttcagggattatgtccctgactgacaaagcgatgaaggattatgacctgaatgactggacattgatttcagcgtcaagtgctgcgatgaccgctacgcttaaaaagtcatacgaccgtaagaaaccgattatcattacaggatggacaccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaagacgaaatgggcgaaatcatgatcaaggtggaagaaggcgagaaacctgccaaagttgctgctgagtacgtcaataaacacaaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatcactttccgcatggctgccgaatacccataaagcatacgccgctaaatataaaggcaaatatgatgatattggcaccagtatgactggtgtgaagatggggcttgttgttcctcaatatatgaaaaatgtcaactcaattgaagatttgaagaagtaatcaaaaaagcagcctgtgtcaggctgctttttttgcgttattttacgtaagcggcagcgggtgaatcagccttttgaaaagtttttaatacggcattcgctaaaatgtgaatgccgttgaacatcgcatttctgtcaaaggtcatgtgcggatgatggagccccggctggagcccgcagcctagtccgagcatcgttgttttcagattcggcaccttcacggcgtaaaaatggaaatcctctccgccggtagtgacaagcgggtcatcaagccgctcagccccgatgatatctgtaatggcttctgccatgatcgcttcagcttctttgttttgtgttgccgcaggaaggctgtgttctttttgtagctcgatttttgcgccgaatgcagcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcggacgggcgccatgagcctcttccccgatgatcgttccctcaatgtgctggcttgatccgtgcagaatagacggagcgcagcggccgttctgtgtttcctggatcggacggacgtgaacgccatacaaatagtcgatatcatcaagcacgccttcttctatcattttcaaggcgccgccgcctttttcttctgccggctgaaagataaaacggattgtgcccttcggaagctctggttgttttttgagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcatcctaaatcctcaagcttttgtttcaaaaatgaagttgtctcatattccttccagctgacttcagggttcgcgtgcagatgctcgaagatgtccataatggtttgtttcatgtcttctgaaagcttttgcatggtaagaaatacctccttctatcagaatgaatttttaccttctttactttatttatattgaaacaggaagataggctgtatataatatagcacatattgctactattcagaataattaatattttcaaacagaggggatggatcgaaatatgagtatgccagcagccgaaacacagcctaagaaaaaacgtatgacatttaaaatgcctgacgcctatgtcctcttatttatgattgctttcatttgcgcaatcgcttcatatattgtgccggcaggtgaatttgaccgcgtgacaaagggggatgtcacgaccgctgttccgggaagctatcattccattgaacagtctccggtcagcttgatcagcttttttacttctctacaggatggaatggttggatcagcacccatcatctttctgatcttattcacaggcggcaccattgctattctagaaaaaacgggtgccatcaacggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatttacatcggctgctacgctggatttaactccaccatattatcaccgtcaccgctcggtttatcacaatcaatcgcggagctccctcttttttctggaatcggcctgcgagttttgatatacatatgctttttgctgtcttctattatttatatctatttgtatacgagaaaattaaaaaaatcaaaagatgccagtgtgttaggaacagattggttccctgcggcaggaatgggcgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcaggcttgcggcgaacgatattgccaaaaccttcattacgggctgccaaagtcttgtatacggggcgctgattgtcgggatggcacgaagcatttccgttatccttgaaaatggaaagctcctcgatactgtcgtcaatgctttggcttcacttttggacggattcagcccgattgccggggcaatcggcatgtatatcgccagtgcgctgcttcattttctcatctcttcagggtctggcgaagccgttgtatttattccaatcctggcgccgctcgctgatttgatgggaatcacgagacaggttgcggtggaggcagttatgcttggagaaggggtcgtcaactgtgtgaatccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcgggattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatatgattgtgaagctggcttacagaagagcggtaaaagaagaaataaaaaagaaatcatcttgaaaaatagatggtttctttttttgtttggaaagcgagggaagcgttcacagttacgggcagctttttttataggaacattgatttgtattcactctgccaagttgttttgatagagtgattgtgataatttaaaatgtaagcgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacggcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagaacttccagatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgcgattcccggggaaaagccaaataggcgatcgcgggagtgctttatttgaagatcaggctatcactgcggtcaatagatttcacaatgtgatggctggacagcctgaggagctctcgaacccgaatggaaacaaccagatatttatgaatcagcgcggctcacatggcgttgtgctggcaaatgcaggttcatcctctgtttctatcaatacgccaacaaaattgcctgatggcaggtatgacaataaagctggggcaggttcatttcaagtgaacgatggtaaactgacaggcacgatcaatgccaggtctgtggctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtaacgaggaccgaggaatacagctttgttaaaagagatccagcttcggccaaaaccatcggctatcaaaatccgaatcattggagccaggtaaatgcttatatctataaacatgatgggggcggggcaattgaattgaccggatcttggcctggaaaaccaatgactaaaaatgcagacggaatttacaggctgacgctgcctgcggacacggatacaaccaacgccaaagtgatttttaataatggcagcgcccaagtgcccggccagaatcagcctggctttgattacgtgcaaaatggtttatataatgactcgggcttaagcggttctcttccttattgaggacaaggctagactggacttaccgaaagaaaccatcatagatggtttcttttttgttcataaatcagacaaaacttttctcttgcaaaagtttgtgaagtgttgcacaatataaatgtgaaatacttcacaaacaaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgcaggagcaaaccaaaaacctggtgagacacgccttgaattagtagaaaagaacttgaagattttcaaaggcatcgttagtgaagtcatggcgagcggatttgacggcattttcttagtcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcgcatattatcggagagcacggcgacacagagcttcctgtttggagtcacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaaccgcggagggatcgcaggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagcgggctgtggcccattggctacatcgtcctgatggcggtgtggctgtataaaatcgcagtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttgaaagcggcggcgctctgcttgattgcaaacgccgcctccggagcctttggggcgatcgggattcctgtcatcacaggggcgcagattggtgatttgtctgctcttgagctgtcacggacattaatgtggacactgccgatgatctcatttttaataccattcctgcttgtattcttattagaccgaatgaaaggaatcaaacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggaaggggccggcgatgctggtgagaaaaaggcataccgtgccgctgacattgcgaaagcgtggtctcctttctacattttaactgcggcgatcaccatctggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctcccgggatgcctttgcttccctgaaggagacaggaaaagagctgtgggtgccgattatgacgatctgcttcgtgatggggtttgccaatctggccaacttcgcagggctcagctcttcaattgggttagcattggcgaaaacaggagacctgttcccgtttgtcagtcctgttcttggctggattggcgtgttcatcaccggttctgttgtcagcaataacgctttgttcggccatttgcaggttgtcaccggagcgcaaatcggtgcgggttcagacttgctgttagccgcaaatacggcgggcggtgtcatggcgaaacttgtttctcctcaatctatcgccatcgctgcagcagcggtaggccaaacaggcaaggaatctaaactgtttaaaaggacagtggcgtacagcctgattctgttattgatcatttgtatatggacgtttattcttgcaaggttaggagtgtaatagaaaaaagcagtacatgcccagcatgtactgcttttttatgttaatttgctttctttgtcatttcggctgttgttttcactctggcttttcccataaataaaatggtaaccgccgcgaggacaattggaatcaaagcgagcaaaaagacatacgtaatacttgatgacatcgcgtcaataatgcgattcaggatcgcatcaggaatctgggaacgtgttcccgcttggaatatctcctgcgggtcgccaatattttgcgtagcacctgatcccgctgagcctttcataccgctgaaggcgtcgctcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagattccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgtgctgtggcaaacaagcggttcttaaacatccagaaagaaataatcggttcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcaaagataatggtaaaggcaatcggcaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccatgaccgccaccatataggatgccgtcacccaggcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcccaccgatttgaaatcagctgacatcttaaatgaagcaggtccgatgacggccggagagctggggaaaaaaaccggcctcagcacgggttccgtcacggcgcttgttgaccggctggaaaaagcggggtatgtggctcgtgaaaaggacccgaacgatcgcaggagagtcgtaatcgtccctttgactgcttcgaaaaaacatataaaggatttgttccgtcctctgtctgagtcaacgatggatttgtgccgcgaatatacggaggaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcgcagttcttgaccgctccatttgtgaaaacgtttttgtggctgttcggcttttttgtcctgacctataccggaattgaaacgctgaaaaacgtcagagaaccgatggatgtgcgaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctcctcgtgtttggcttttactttggttatcagggcatcaaacagttattgggctgattcttgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctggcggacgatgcggatacgtttccgtgcattcccggacgccaggcgtttctgactgatcagcttcggattgcttttgccggagatccgcgggaaaaccgtacagcggaggaactggctccgttgcttgcggagtacggcaagatatcgcgggacacgggaaaatacgcatccctcgttgtgttgtttgatacaccggaagatttggcggagcattattcgattgaagcgtatgaagagctgttttggcgctttttaaatagactgagtcatcaagacgaaaaagaatggccggaagatattccggccgatcccgagcattataaatgggagttttgttttgacggcgagccgtatttcattctgtgcgctacaccggggcacgaggcaagaagaagccggagctttcctttttttatgatcacgtttcagccaaggtgggtgtttgatgacctaaatggatctactgcatttggccgtaacatgagcaggctgatccgatctcgtttagaggcctatgatcaggctccgattcacccgcaattaggctggtacggaggaaaggataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtaacgatggcgatgatcacgagaaaacctatgctgacgaaaaaaccgggccggcttgatttttcaaataatgtaccggacacagctacagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagaggacaagccccgcaaacgtcagcccaagtgccggccagcatatttttttgccttcctttagagtaaagcatttcggcgcgtcgccgtcatcagccattgtacaaagcaatgtcgtaacggcaaaaagcgaagcgacaagggtcgagaacccggcgatgatgaaaatcccgttaaatatatcaaggatgatctcaaggttatatccttttaatgatgtaatgaacggactgtcctgttcagtaaacgcgtgtaacggaaccaaaagcagagcaagcccgattgaaatgatataaataatcgccagcgtcgccagcatcagtttccctgatttagacgcttcctcaggtttttttaagtgaaccgccatcagccccatgacctcaattccgccaaaagcgtaaaacgcgtagattaaacctgtccatagccccatggcgccgtatgggaaaaactcactcgtcttatttggaacatgtatgccatggtttccgccggacaggataccgcataaagccaggatggcaatgacaataaacataaaaatagcagctgttttaatgactgccagcacgttttctgttttttcaaagacggacaggccggtgaaaataataaggagccccagtactgcgtagattgaggcaaacacccatagcggcacttgaggaaaccaatgcttcgtaaatagcgaaatggctgtcagctggcttccggtaatcagcatttctgatgaccagtacacccagccgttgctgaagcctgcccatttgccgaatgcttttcgggcatacgcacaaaacgatcctttttccggttgcttcgccgaaagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccgaagcttatatacatcggatttttgcctctttttacatggagaaggaagcggacgctcatactaatgaaaaaaggagcaaaccaatgacacagcaatatattgtggagccgaaaaaagggcttgggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgctaaccctgattgaagatacggtcggcaagcatgatctgctgctgcccgcctgccgtcctgatatgaacaggctcttatatgggaagcaaaaggatgagtttcaggatacgtgctatgacaatatgaaccgtgcgcttgagcagtttggcgtaccgaagcctcacatgcattatccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcgggggccaggattcaacacttgcgggaagactcgctcagcttgcggtggagagcattcgcgaagagggcggagacgctcaatttatcgcggtccgtcttccgcatggcacacagcaggatgaagacgatgcccagcttgctttgaagtttattaagccggataaatcatggaagtttgatattaaatcgacagtcagcgctttttctgatcagtatcagcaggaaacaggcgatcagctgactgactttaataaaggaaacgtaaaagcaagaacaagaatgatcgcgcaatacgcgatcggcggccaggaaggcctgcttgtgttaggaacagaccatgctgctgaagcagtgactggtttctttacgaagtacggtgacggcggagcagacctcctgccgctgacaggattgacgaagcgccagggaagaaccctgctgaaagagctgggtgcaccggaacgcttatacttaaaagaaccgactgccgatttgctcgacgaaaaaccgcagcagtcggatgaaacagagcttggcatttcctacgacgagattgacgattacctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacagaagctttatttgatgcggatatgattcagctttaccattaatctgtcggtgaaccttcggaggctgcctctcgtatcaggatctaatggaagttcggctctcgcggcaatgttctctgccacatcctgaatcgacaggttgtctgtttgaatgtggtcctcaaaaataggtgatgataagccttcaacgcagcggtcaatttgtttggcggcccaggagttttttccttctgctctggtgcgcagtctttttaacaaggtttcctttgaagccattaatgtaaagtggtgaacgatcctcccttcatgtctgagcctgccgatgatctcattgaagtattcaggatgtacaatcgtcatgggcacaataatgatgccgcggtatgtatctgtcagagaagctagcaaactgtaattgaacgcccgccataaaggatagctttgaaaatcgtcctttgcgatctcctgcggcaccatggagcgcagcgcaaaacccattttctcgggatcatacacgtaagatggtttcagccttctgtgcagttcgaaagctgtttgtgtttttccggaaccgaatgccccgtttatccaaatgatcatcgccatttctcccttcctatttatcatacagaaaaagacccttccatcgaagagtcagctggaaaaacaataaaggcagaaggttttaatgcttttttgcgtcgaagtattaaaatacctgcagaaatgttgtacaatgaatgtcattcaggcaaaaatggctaaacaacaaagcgcactataagcttgaccggtaaagccggtatctatataaatattcgctaaataagcatataatgaatatataatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccaagagatcgaaaaggatttcaatatgacaattcctgagatatttgagaaaaagggagaagactttttccggaaaacggagaaggaatatattttagacatctgccatcataaacgattcaaaatcgtatctctgggcgggggctcttttaaacaagaagaaatcagaaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtggttcaagtgggcaatgatttgtttttctcggtcagcgggggttccgcctcgtttgatccagctatcgtattgaatcggcaaattccacttttggatgtcttgataggccagttgattggcgctgaacatcgcctgccattctgataatgagctttctcgaacatgggaagggtctcgaagccggttcaaatgattgacaaactcatcaagaatgggatcttcaggcgcgtaatgatcaactaagagaaaacgtccgtcctgtttcagtacgcgtgcaatctcgctgacagctttgcggacatctgaaaaatggtgggctgcgtatcggcaggtgatgatgtcaaatgaatcgtcggggaaggggagtgactctgccgttccttgctgaaagcgtacgttttcagctcctttttcttgcgcgaaggaggacgcaacctcaaccatctctttcgtcgcatcaacaccgatgcactcctgtacataaggagaaaatgccagggccgtatggccggcgcccgctcctatatccagcactcgatgctctgcccggcattccgctgttttgatcatcaaccccaaatcttccccctcggcaaataccttttcatcccgatacatctcggcgtttttagaaaacggtgtttcattagtcatttgaaccagctccttcttttcgtaaatgatgatatggattatgttagcaatttctgttatgattcgtccaagatataaaaatgatgaaaatgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggggcttaccctttttcacagatcccatagctctgttacactgacacctcacggcaggcgtttcattgaaaaagccgaggacatcattcgttccagagatgatttgcttcgggaaatgcaggagcgatcacagggaatcggtcataaattatccatcgggattcctgctgtaacagggagatatctctttccccgctgctgaagcagtttttggcgcgctatcctcatgtggaggttcagcttgttgaaaaagatccggtttcattagaggagatgacggcaaagggagaagttgacctttctgttttatccttgcccatcgaggatgaacggctctccattacacccttgctcacggaaccggttgttctcgcggtgccgaaggaaaaacaaaggtggatgccgccggaattggtcgcgctgattgagaaagcgctggaagaagatgagggacgccagccgtgtgtgccgatagacatggtaaggaacgtgccctttattctgttaaaagaaggcttcggctttcgcaggacagttctcgatctctgtgcggaaagcggctttaagccgaatgctgcctttaagacgagccatattgaaaccgcccaatctcttgtggctaacggattaggtgtgacaatggcaccgaatatggtcagaagggataaagatccgggtgtgatctatttatcgattcaatccgcgccatcacgaaccctcgtctttgtctttttaaagaaccgctatgtcagtctgaccgcccaggcctttatggaactaagccgggaaagtcttaaacaaacgtttgatgaatgctgtctgggaaacaaagatgaaaatatttagaaaacaaagccgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatttacagccggttgactatcctgctgacggagtaaaagtgtaccgtctcacatataaaagcttcgaaaacgcccggattaccggatggtacgcggtgcctgacaagcaaggcccgcatccggcgatcgtgaaatatcatggctacaatgcaagctatgatggtgagattcatgaaatggtaaactgggcactccatggctacgccacattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggtcatcagcagcttcgacgaggttgacgaaacaaggatcggtgtgacaggaggaagccaaggcggaggtttaaccattgccgcagcggcgctgtcagacattccaaaagccgcggttgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaatgtgaaaagccgccgcatatcatcaggcggtttttttctgcaaactgccggaatgagaacagactggagacgaatagatatgaagcaaagaatcattgatgaattaaaacggatcgagcagtcatacggagtcaaaatcgtgtatgccgtcgagtcaggaagccgcgcatggggatttccctcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattacgaagcatttacgaccgcagagcagttaagaaaactgcgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaacggaaaagaagaggagaagagcttgacctcgaagcaagaatcaatgttattcaccaattcattgaaacggaaatcgaaagaatcatggaagcggcaaaagaactgaaggcagagaaaaaagatatgacacctgaattgaaccgtttgcttttgaatacggttgaagaagtgtggaaggatggaggaagctgatgttttttgtcgcttccttttctcctttattcgacagaatccccccgactttctaactatctgattgtggcaaacccacaaaaataatcagaatctttgtattttgagaatattgtgaacgtcggttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgaccattcgacagcttaacagccaaggtttgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctattttatgagacgccttgcagaacgtccgtcaaacattgcatttgctttcaaaggaatgacaaagaagtaaaaaaggagagattatcatgacaacaccttacaagcacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcgtctcaagagcacgctgagcaagcgattcaagcggctgcaaaagcatttgaagagtggagatatacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagcagggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagttgttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagattggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattacatgctgggaggacgctctttgggtccggcagtaaccgctctcagtgccggcgctgccgatatgagcggctggctgctgatggggcttccgggtgccatgttttctactggtctgagcggagtttggattgtgttcggactttgtcttggagcgtgggcgaactggctttacgtcgcaccgcggctgagaacctatactgaaaaagcggggaattccattacaattcccggattcctggaaaatcgtttcggagatcaaacaaagcttctcagactgttttcgggaattgtcattttagtctttttcacgttttatgtatcgtccggcatggtgtccggcggcgttttattcaacagcatcttggggatggattatcacaccggcctgtggattgtgacaggtgttgttgtggcatataccctgtttggcggctttttggcagtcagctggacagattttgttcaggggatcattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgatcacgtctgtcaaagagatcaaaagagcgcgcagaatcgggatgggctggatgattttgtctgcagtaggcgcagtgctgaccggtttgggcggaatcgcttattaccatcagcggggcatgacactgaaggaccctgagacgatttttattcagttagggaatatcttgttccatccgattatcacgggttttctgatttcagcgattttggccgcgattatgagtacaatttcttcccagctgcttgtaacatcaagctctctggtagaagatttgtataagtcgatgttcagacgctcagcttcagataaagaactggtgtttttaggccgtctggctgttctggctgtttcaattgtcgcgttggttctggcttgggagaaaaataacaccatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtgttttttgtcagcatattgacgcaggctccgtcacaagctgtcacagaccagttcaacgactaccaagatacaatgtcacaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataaactgattgattttattagctatgagctgcaaaagccagtgatactggaaagcgcggatttctttttgttagcctataattcttactatattaaccattttgattctgccaaccagcagactattttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggtagaggatttaaaggaaaatatcaggtcgtacctgaatttacgggataaggtcagtcatgtcttaacgatcgaatcaaatattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcgaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaattgcgtttcctttgtaagcaaatccatggaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaatacaagctggcatcaggccgcaaatactgtgtttgggagtagtgatctccgctctccatcgccttaaacgagaacccttttgttttgacaatggatgagtcaagcgttgcaatcgggaagaagatgcctgacaccaaaggaaaaagaaaaacaacataaatcaaataacgctgataaaatggcttgttttgttcatggtcatgctcgtgatcatggccgcacccgcaatcatggtcatggtgatgcccgcttttttcaggcgacttgataaatagatacgcttggacggcggtcagaatagccagcaggaagatcgcaataaaggacagataggaatatttcatattgatatattttgttagatttcctgaggcatgcagatgataaaagaaaaacgtaaatcccatcagcaccaatagacgaaacacccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgatgattaaatattttcccacggagaaaaattcatcaatggcatgccgcaaggtcccgcccagtttttggagcaaggtgccgtgatgatgatggtggtgcccgggttcatcaggctttaaaagctggttatccttaaattgataggataagatgaccccgatgatcagcgaaacggcgagagccagtccgcctctgtaaaagacaacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaggggaaaggatcgtttcactttggttaggattccaaaaagccgagtaagatactgtctgtttctgcagcttcttttccgagccaaatcaggtgtccccatgagtgaagcaaacagagagcagcgccacgaatgtgctcttttgcatgatgtgcatgtgacaagtcaaccaatccatcataaacactttgcataatcagcacgggagatatgatggcttgcaggtcttttaaagagacagcggcggtttgtgacaagtcaatcagaaatccttcacccgagcgctgccggctgttcattttccgaaatgcttctatgtctttttcatccattaaggacttgattcgctgaaacggaatcgtgctgaattgggggctcatagctcgaaacatcaaacgcgggaaagcgttattcaaagaagaaatcagcttccatatccacttttccaccggcgggcggaagagaattctccccaatttatattcagtgtcttttggggtgagccactctttggtgaccgcggattgcagggtcaatgtatttactctttctggataatgtgaggcaaagcatatgccgctcggccctcctgctgagatggcgatcacatggacactgtcgatttgtaaatgatctaataatttcacatagaaacggcaggcgttggcaagactttttccaatttcttttgacgttcgtccatagccgggtcttgaaggcgtaatgatggaatacccttgttcaatcaacgctgtgtatccgaattcctcgtaacaatttgaatgcccgccatgcatgacaaggatcggagttcccttgcctgtcacagaatattctagtgtactgccatcgaaggtgatcgtttcgactcgtcttttcatctgtttcacccaattggtttttgcctattatagagttttcagcaattgaccacaaggtagaagaaatgaataaacaaaggcccttgaaatatgatatactttgtattgatattcattctcaattaaaactttgatatagatgtgaacgggaggcaggacggatggctgagaatcaagaggtatatgacgttacgattataggcggggggccgattgggctgtttactgctttttactgcgggatgcgggagctaaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctagatgaaggcaccattgttctgacgggttctgaaggggaaaagcactatacaagaactgtgattttggcttgcggcatgggtacacttgaggtcaatgagtttgacagcgaggatgcggcccgatatgcgggcaaaaatcttcattatggagtggagaagctcgatgcgtttaaagataagcgcgtggtgatatcaggcggcggagatactgcggttgattgggctaatgagcttgaaccgattgcggcgtctgtgactgtcgttcatcgccgcgaggaattcggaggaatggaaagcagcgtgacgaaaatgaaacaatcatcggtgcgggtgcttactccttattgtctagagcagctgagcggcgatgaagagcgcatcaaaagcgtgacgatttgtcatgctgaatcaggccaaagggaagatatagaggttgatgagctgatcattaatcatggcttcaaaattgatctagggccgatgatggagtgggggctggagattgaagaaggaagggtgaaagctgacagacatatgcgaacgaatcttccgggcgtgtttgtggcgggcgatgcggctttttatgaaagcaagctgagattaattgccggcggctttaccgaaggcccgacagcagtcaacagcgcaaaggcttatttggatcctaaggctgagaatatggcgatgtattcaacccatcataaaaaattggtacataaataaaacagcccttggggaaagggctgtttgccatcagctgtgaaggagttttctttccgcttgttgattttggatgaaagcaaataattcatcctgttcttggatggctgtgaatccataagccccggcagctgagtcatcgcctatacagacgatagggggccggcttgctgacggttccggcgaaatgccaatttgttcgccaccattgatcaattgctgaacggacagcttgttcgggcaaatgaccatgtgcagctgggattcactgatggtacgctgaatcatgtgggtgaaccggtcatctatgacgttttcatgagtgatataaaacgaacaggattcttgcttttgcatgaattccactgcatggcggctcccgacaacaagacgtttttctgaatcaggctgaatggcggtgacaagaaagccccgtttttcaagctccgtctttgcttgctcagatgctgcactcagtttggctgtcagctggcggatgtcgattttctgagaagccagtgctctgaaaaattcacaaaccgcccggcgcgatgtgaaaaaaacgtcttcaaaggtgccaatctttcgaagaatttcttcattgacaggcatgttttcggtccgccatttcggccactcgatgagatcggcgccggaatcgcgcagcttgtctgcaagcgggtcttcatcttcgccatgagtcacaaccatcaaatgccgtccgatgagcggtttgctttcaaaccagctgtgtgtttgaaagttgacgatgtctccgatgacgataatcgcagggtttgtaatctggtgttcctgcactttttgctgaatgttctcaagtgttcctttcacactccgctggcggccccacgttccccattggatgacaatgacagggacagaaggcgatttcccgtatgaaataagctgctggcaaatataagacaagttcttgacacccatgtaaaaaacaagggtttgtacgcttcgggctagcccttcccagtcaaggttcggcgtgccttttaatgatttatcatgcgctgtaatcatggcaaaagacgatgcaaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaatccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcatgcatcgggcagaaaacatattgaccgctgacgatgccttctgccaggacgccgcccttatgcggacagcggttttcgatggcgcggatgcttccgtctgaaagcttgaaaaccgcgagctccttatcttcaatatacactgttttgcctaattgttcaggcaattcttcaatttttccgatacatacttttgttacgtctttgtttaccatgtccattcctcctcaatgatttttttgtcattatgatgtggtcacgacattttcaaataattctttagaggtttgtttatcctctaaaaagtctttccacggatccttgtggacagagagtgtttcattcattcggccgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaaatgggttccgccgtttccgccgacataaagctcccagcctccgtcaatgccgacaacgccaaggtccttaatgccggattccgcacagtttcgcgggcaggcagacacggccattttgactttgtgaggcgtgttcagcccttcgaattttttctcaagcgcaatgcccagtgccatggagtcttgtgtgccgaagcggcagaattgctcgcctacacatgttttcactgtgcggagcgtttttccgtacgcgtagcccgacggcatatcaagatcttcccataccttcggaaggtcttcttttttcacgccgataagatcaattcgctggccgcctgtcattttcacgagcgggatctcatatttgtcaacgacatcggcgatcttgcgcaagtctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagcgggccggcatttagaacagccttctggcgttttccagccgagcacattcatgacttctcttgtatgtgacagccctttggctttgatttcttctacgacttcatctctcgacaatgtggtgcagccgcaaatggcttctttttgcgctgacgcatcaaagtctgatccgagcgtatgctggaggatttcttctacgagcggcttacagcctccgcatgagcgggatgcaccggtgcatgctttgatttcgtccgttgacgagcagcccttttcctgtatggcttgaataatcgcaccttttgacacgccgttgcagccgcagatgatttcatcgtcgctcatcgctgcggttatgcttgtgcctgcttcttggctgagaggctgtaagattgatattttagaggtttcagagatatcggcttctttttgaatcatagaaaacaggcgattgccttcgctgctgtcgccgaataaaacagcaccgacaatttgattgcctctcaggacgatttttttatagatgccgtcctgctcatcgaagactttaatcgcttttttctcctctgattcgttaaagtcaccggcagagaagacctcgacgcctgatacctttaactgtgtggagagaacggagccctcatacggttttgtttcgatgccgcaaatatgctttgccagcacttttgcctgttcatacagcggcgccacaagcccgtaggcgattcctcggtgctcggcacattcgccgaccgcgtaaatgtgcgggatttcagtctgcatataatcgttgacgatgatgccgcggttaaccggaatgccgctctcggccccgagcgttgtatttgggcggatgccgacagccatgacgactaaatcagcttcaatgcttgtgccatccttgaatcggaggccttcgacacggtcgtcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacatccatgccaagattcagcagtccgcgagctgcttccaaaccaagaagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaacactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggcgcataccttaaaaccgggcattttacaggctggatctaaggcttctccgattaaatcattcacattttgagcgtctgcccaatgaatgggaacaaaaacagtatcttttctgatttgttctgataatttgctgcggacggtgatgcttccccgcggcgattctatttttaccagtacacggtcctcgatattgtaggtcgctgctgtttgcggatggatctccataaacgattcaaaatgtctcgcggcaagggcggcgctttttcttgtttggacgcctgttaagtagtgagacatgactctgcctgtcgttaaataaagcggataatcggctgttggcttctcttttggaacagatggttcgtttggaatcacacttaatgccgctttttgatccggatgagcaaatgattctgtaaacaagcgcccagttccgggatgatcagattccggacacggccaatgaatgccgccttcacgtctgagcctgccgtatgagatgcctgaataatcggcaatcccgcctcggctcgcttctctcaattcattaaaaatatcctccgctgacgtataagagaagtagcgacccttgccgagagcggatgcgagatcacaaatgatctgccaatcatgctttgcttcgccgagacatggccggcttgcttctcttaatgtcacgcgtccttctacatttgtcatggtgccttcatcttctaagtaagaggaggcgggtaaaatcacatctgcgtatttcgcagtctcagaaataaacaaatcgattgcaacaaagaatgtcagtttacgtaaagcctttttcacgagattcgcatttggactggagacagcaggattggagcacatgaggaacaatcctttgatgtcgccgtcattgattttttccatcatttcataggctgagacaccttttcgcggcagatcatcctgatggattccccacacttgcgcaacatgtgcccggtgttgttcgttttcaatagatcgatagcccggaagctgatcggctttttggccatgctctcttgcaccttgcccgttgccttgtccggtgatcgccccgtaacctgagtaaggcttgccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccgccagcgggacactcgtctgttcggcgatgtcattcaggtccaacgagtcagtatgctgcttcagctcttcgaatccatttgttcgtgattgaatgaaatcctcgtttataagctgttcgtcaatgatgattttgacgaggccgttggaaagggcggcgtctgtgccgggtttgattttcagatgaagatcggcgatttttgttgttgctgtttcacgcggatcaatggcaatgatgtaagctccgttttctttcgctttttcaaaatacggcataatcgtaggctggcattccgcgatattggtgccggccagaatgatcacacgggtgtggggaatgtctgataagggattcgttaagcctctgtcggctccgaatgtttggttggctgcggttgctgcggcggacatacaaagcctcccgttatagtcgatgtattttgtctgtaagcccacccgtgcgaatttccctaacaaatacgcctcttcatttgtaatcgaggcgcttccgtataccgccatggcgtcatggccgtgttctgcttggatcattgtcacttggtctttaatgtaattcaatgcttcttcccaggaaacagggataaactcgccgtttttcttcagcagagggcgggtgatgcgagaggagttcaaggcatgctggtgagcattcatgcccttcatgcatagccgaccctgtgtcgtaggattatcaatcccgatcgcagtgtactttttgcgcgtgacgatggtttgttccacgagctgcattttgcactgcatgctgcaaaacgggcattgagtgtcatatgttttttctgattggacgtcttgctgtttatcacggaaatatctaagcagtcgttcagtcaaaatgcctcatcctttcttatatgcgcccgtctctacagtcgggttttgaatcagtgacagatctgtttggaggctttccagcagctgtgcccttaggtcttcttcgaatagcacttctctgatatgaacgatcccgagacggtctatccactgatgaacagcttctaagtaatgagccgtttcccgataatactggatcagtcctttgatcatgccggcagtgctgtcttcgttctcagtcacgcaaaacagagctcctgaacgggcatgagttccccggacgccgccgatgtgaatgtcccagccagcttgtgtccgaattgcgccgacatcttgcagggcggcatcggtgcagtcagtttcacatgataagctgatagaaatgggagcgggtaagggaagcgtctcaagttgtctttcgatttgggctgccagctgctgaatcgatcgattttgcccgcatgtacatgctttgatggtttgcagcgtgtgtcggtgttcattagtgtaaacgggcattttcaggtcttttttcatgttcgggagatccgcaggcttgatcccggaaagcttcagcctttggccgtgagtgatggatacgtcggaaatgctgtatgcctcaatgatgttagcgatggttcttagctgatccgcgtttgtccgccccccgtacatttgcggaatcaggatgcatgtctcttcagtggctggctcaggctgtacaaacccggggtacagcatttccagatagtattgaatcgcaggaacacaagtactgcatcctttttttgttttccagtcaagctggttcatcacttctgccggattagtgaatggcctgcgctgaagctcagcgatgatgtcgtcttctgtaaaatcagtacagccgcaaaacgaaagtgtgccggcgggcttcgtatattcgctgttggtcatgtacctcaaaaggtcttcaacgagcggtttgcatcctccgcaggacccagaggctttggtgcagtgcttgacttcctcaacagttgttaagcttttcgtgttcaccgcatcttcaatcgcgcctttcgtcactgtgttgcattggcaaatcgtttcactggaaggcatggattcaaataaagtgctgcttgtctccggttcgatgatctgctttttgacaatggagatgtctcgttgtttaagcaggctgtcgagaagccgctgcttgtcacgggtgtctccgaataaaataacgccggccagtttgtcatctacaaaaagcgcttttttataaacgcctgcttgttcgtcgtagattttgatgctcgtcgtgcgttcatcctcttggatctttcctgctgaccacacatcgattccagctatttttaacgccgcagatggtgctgagccttgatattcctcacatggaacgccgcaaatatgactggcgagaacttttccctgctcataaagcggagccaccaatccgtacaccgttccgttatgctcagcgcattcaccaacggcgtagatattcggttcgcttgtctgcatgaagtcattcacgatgatcccgcggttcactttgattccagcagatacagccaattcaatattcggtttgacgccggccgccatcacaatcaagtctgcttttaatgaagagccatctttaaaatggattcggtctgctttcgtggtgccggaaatggagacggtgtctttctccaaaagaaaggttaggcctttttgttccagctctgtttgcagcagccgcgccgctgtttgatcgagctgtttttgcataatgccggcggagtggtgaatgacgctgacatccataccgagatgctgtaaaccgactgcagcttccagtcctaataagccggctccgattaccgcagccttttgaaagtgctgggccatcctcatcagcgcttggcagtcttctattgtccgaaatccatagacaccttttttgtctgccccggggatagggagaatatgaggggaggagcctgttgccactattaatttgtcatacgacagagtgcgtttccgatctgtgatgacctgctgctgatctgtatcaatttgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccatgccgtttcccgctaacaccaatctttgtttcttcatgtatcagacctcctttggcgaagctcgtaagttttctcctattaaaaattatgtcacaatgcactgttaacgcattaaacgtgtcacaaaaacttacacatgtcttttccagaaaataatggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctaggtgtttatatttctcaggattttggcctgtctccttttgagaaagggcttgtcgtagctgtgccgattttatctggatcagtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggggcaagctttgctgtagcgctgcctatggccagccgatggtatccgcctcatttgcaggggcttgcgatggggattgccggagcggggaacagcggcacgttgtttgcaaccctgtttggccctcgtctggcagagcagttcggctggcacattgtcatgggaattgcgctaattccattattgatcgtctttattctttttgtatccatggcaaaggattctcctgcacagccgtctccccagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcatgcgggggacttcgttacattatgtgtggcggcggggagctttttccggcctgtcgggggcttgatttcggatcgtgtcggcggcacgaaagttctttctgtactgtttgtcatcgtggcactgtgtatggccggagtcagcagcctgccatctctctcaatggttattgttctattgtttgtcggaatgatggggctcggaatgggtaacggtgcagtattccagctcgtgccgcagcgttttcgcaaagaaattggcatggtgacgggaattgtcggtgcggccggaggaatcggtgggtttttcctgccgaacatcttaggatctctcaaacagatgacaggcacatatgctatcggttttatcacgttttcctgtatcgccctgctggcatttgcacttgtgcttgccgcaggctattactggagaaaaagctggagcgcggaaagcagcccggcggatgtttagggttttgacggacacgcgtttgtgcgtgtcttttttattttctcttgattttcaacagtgaaccgatcaaaataaatagtaattattacgatttgttagcgagaggagttttctgaatgaatcaacatacgctgctcccgaaaaaaacggagcgtcttcaatactttggatcggtcagtccgatcaaaggcgagaaaccagtggaaaaagagaaaatgaaggacctgcaaaatatcaggaaggattatttttttgacattcagcatgtaggtgtagctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaatggctgggttctctcattttcctctcttcagcaatttacgaaagagcttgcagaaaacatggacatatcatctgccacagttgaagtgaggtttccgtggtttttcgaacggaaaagcccgaagcttgagaaagcgggtttgatgcatgctgatatattcatgtctgtcacctatcgcaaagatcagccgtttaaacagcgtgccggcatctcagcaaaagtaacgactctgtgcccttgctccaaggaaatcagcgaatacagtgcccataatcagaggggaacggtcagcatttgggcggatattcacccggccgcatcgctgccaagtgatgttaaagctgatttgcttcacgccgcagaatcaaatgcttctgcgagactgcatccggtattgaagcggcctgatgaaaaagccgtgacagaaacggcctatgaaaacccgagatttgttgaggatctcgtccggctgattgctgctgatttgtttgagcttgaatgggtgtcagcctttgagattgaatgccgaaatgaagaatcgatccatctccacgatgcctatgcgaagctgtgtttttcgaaggaagtggatagaatatgaaactctcattattcattgttgcagttcttatgccagccagcctgctgtcagcctgctccgatcatgcagaagaacacgcaagtatcaatacaaagaaaacggtcgaaaacataacggatgttcgaaaaacagcaaaaacaagcattgattggacgaagccttcgggcggagaatacccggatattaaacagaagcatgtctggattgatgtgaatgtgaaggagcagaaggcttacatcaaggaaggaagcaacactatctatacaatgatgatctcttctggtcttgatcaaacaaaagatgatgctacgccaaagggcaccttttatgtagagcctgaacggggagaatggtttttctccgaaggataccaggaaggcgcagaatactgggtatcatggaaaaaccacggcgaatttctatttcatagtgtgccaatgacaaaggatcaaaaagtcatcaaaacggaagcagaaaaactaggaacgaaagcatctcacggttgtatcaggctgatcattccagatgcaaaatggatatatgaaaatatccctgaacatacaaaagtggtgatcagctgaattgaaaaccgttgacaaaaaggaaaaaagaccatacaatttaaatcgtaacaattacgttttatgataaatggcttatcattgtctgtgcatctgtgaaaagcggaaaggcatcgattaaggatcttgctgtcggcaagggcagggatttgcgatggggaaaaggattaaacgcggttggagcctttactgatttataaatcgggcggcagcgagaaatgagcgcgaaaagctgctctacaccattgtacatatggcaaagtatacaatttaaatcgtaatcattctattttaatggaggcattattatgaaaaaaattccggttaccgtactgagcggttatctcggtgcgggaaaaacaacattgctgaacagcattctgcaaaatcgcgaaggcttgaaaatagcggttatcgtaaacgatatgagcgaggtgaacattgacgcgggcttggttaagcaggaagggggcctttccagaacagatgaaaagcttgtggaaatgtcaaacggctgcatttgctgcacgcttcgcgaagacttattaattgaagttgagaagctggcaaaagacggacggtttgattatatcgtcatcgaatcgacaggaatcagtgaaccgatcccggtggcccagactttctcttatatcgatgaagaaatgggaatcgatcttacaaaattctgtcagctggatacgatggtgacagtggttgatgccaaccgtttttggcatgattatcagtcaggcgaaagccttctggaccgcaaagaagcattggggaagaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaagttcattcgttccgtcaaaggaaatgtaaaaccgcaggagattttgcatacagggttatttaacttcgaggaagcgagcggatcggcgggctggattcaagagctgacggcaggccatgcggaacacaccccggaaacagaagaatacggtatctcttcatttgtatataagagacgtttgccgtttcattctacacggttttatcaatggatagatcaaatgccaaagaacgtggttcgtgccaaaggaatcgtctggtgcgcatctcataacaacctcgctttgctgatgtcgcaagcaggtccgtcggttacgattgagcctgtatcttattgggtggcggcgctgccgaagcttgagcaggagcaagtcaaacagcaggagccggaaatcctggaggagtgggacccggagttcggcgaccgcctaacgcagctagtttttatcggaactgacctggatgaagaaacgatcacgaaagagcttgatcaatgcctgttgactgagtatgaatttgattccgactggtcgctgtttgaggacccgtttaaatggaagctgaatcaatagaaaaaaagccgtcccatggggaacggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagatgacgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaacggttaatttccgcaatgtaggcggcgctgttaaggctaaagccgattaaagcagccgtgatagcggaaaattgaatgccgatataaggaaacccgaaataaaggataaacaaaatcactaaaatcggaacgccccgcataaatgagatatagagcttcgccggccatcttaacaaagcaatcttagacattctggcgagtgatatgaacaggccgatcacagttcccgcaaacatgcttacaaaagagatgagcagtgtatacccaatgccttttatgacataagggaacgattcaatagccagcttcgtgttgaaaatatattcccattgaatgctattgatcatggcgtccgattacaaatcaacgtcctgaacgtcggcatcaattttttttgatacatctgctttattgaagaattgtttcgacagtttagtcaaagagccatccttgctcatctctttcaatgcttcgttcatctttttctgaagtgcctcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccgttggcaacatcttttaaatattgctcattcgtcgcattatcataaatcacttctttggcgccgtattttctcgcgacatccatgtagacggtcgtagccgcgccagccgctttcttcccttttaaatccttaagcgttttaatcccggataaatcgtctttacggacaattgccgtaccgtatgaatatttatatggagtagaaaatgcgaacttcttctcgcggtccttcgtcacatcgatgtcattcgcggctgcgtcaacctgtccgctgttcaccgctgtcagcatcccgtcaatgcccatctccttgaactcaaccttcagtcccaggcgttttgccgcttcacgaacgacttcaacctcgtagcccgtcagcttatcggagccagagtcggtatcatgataagaagtgggataaagcgtacctgatgtagcgactacgattttccctttgtccttgatttgctcccagcctgtatccttggaatcggcttcatttttgccggaacaggctgccaatataagaaagaaagccattgtgaaactgaatataacggctttggattgcttgaatgatttcacctatatttcccccaatctgttaatcaactaaaaagatagcattgaacataaggggttgcaatatgttgatcgcgttttcaaaaagttcgaattgtgtatacaaaaagcataggtgggtgtttaaaagcgtctatgaagggaagaggtgatgaaaaaaggagttgtccaaggatgaatgccagacgtaccaaggaaacacatgtggacgtgatggatgcagaagatcagttattcctctatgccaataccgtaagaaatggtcaagaagcatgaaatcgatcttcagaataaatttaagtcttgctgatgcccctaagacatatgatatatccgatgagaaagaaaatggaaacatttaaaccataatggggagtcaaatgaatatttacaaaccagccggattttggatcagacttggagctgcattgttagactatattatagtctccgtgccgcttttgctgatctattggctgattacaggaaaagacccaaacgacagcatgttcatcagtttggttgttctgctgtattctattttgctgccggtgttttggcgcggttatcttatcggaaaaaggatctgcggaatcagaatcgtaaaaaaagacggatcacaggtcagtctgttaacaatgtttttacgggttattgtagccggcctggtttacgttataaccttcggactcggcttgatcgccagcctgattctgattgccgtacgagaagacaaacggaccctgcatgatttaatcgcgggaacatatgtcacttatgcgacaccaggtgaagaagaacttaatgctgacgaagagattagaaagagcgaataatggttcgctctttttatttttatgcataaaaaatacaaggcagcaaaacatatgaaaaataggattggaggaataaactggatgaaacgaataaccatcaacattatcacaatgttcattgcagcggctgtcatttctctgaccggtacagctgaggccgctgaaaaacagcagcagccacccgcaaatgttacactgacagatcagcaaaagaaagagattgaacaactggaagcagagattcttaaaaagcgcaaagacgtgatctcaaagtatgtacaatacggtatcctgcctaaagaaagaggagaacacatcaaaaatcacttggacaaacactttgaaatgatgaaacaaaacggctttgttccaaagcaccatcctcatccgcataaatttgaaaaaagacattaaaatggtaagcatccaattggaattgggtgcttttttattgttaaaagttactgaatgaattttccggaaaaatatatcgcttttgttgattatatcttataataagatataaatggggtgtataatgatggaaatggatttaatctctaaacttaatcagcagtggacagatatttattatttattacattatcaacataaagataatatttctcaccaggcaatacggattatgcagcatattgaaaagcaaggtgaggcaacaataggagctttggctgaatacttgtctgtctctcacaatacggcgtcagagcatactaaacgtttgattcaaaagggatttatagctaaacggcgaagtcaacaggatgaacgaaaagttttagttttcttaacacaagaaggaagatctgttcttgaacagcatacacagctagataaagagaaattaaaagaaataattgaacgaatgagcacatcagaaaagaaattacttgaacaggcatttgaacttttaagtagggaagctaaacaatggcagttttaagtaaagtaatcatctctgcgttgattatcggttttgttactgaaatatcaaaaagacatccgacctatggcggcatcattgctgctttgcccttggtcagcttattaagccttttttggatgcaaatacaaggtgaaaaaacagctcaattaagtcaatttgcatctggtgtgcttacaggaatcccagctacagtttgtttactagctattttggcttttttgctgaaaattcatgtgccgttttggtttgcattatgtgttggaatactaggatgggctatgtttttatggatgcagaagatctttctcaatatattatttaactgagtatagaaaggagatgctatgtttttaaaaaaggttactcttcttcgagataggattttggactttgacagatttccttttactatcccggctataagtcaattaaatgacatcttatttactagccaagtgactttttttgtggggaaaatggatctggaaaatctactttgcttgaagcgatagcagataagtgtgaattcaatacagcgggcggaagccgaaataatgtctatgaattacgggagtcagattcccatttaggagattacatacgtttatcttggcttccaaaggtaacaaatggcttcttcttaagggctgaatcgttttatcatctttctcttcatctggatgagatggaactagatgctcctcagccataccgttcctatggagggaggccgctacacaatcaatcacatggagagtcctttatgtctctattccgtcatcgttttaaagagaaagcgatttaccttttagatgagccagaagcagcactttctccagctagacaattagcttttttgagagttatacatgatttggtgaagggcggaaatgtacagatgatcattgcgactcactccccaatcctactgggctatcccaatgctaatattttaagctttgatggtggaagaatacatcatattgaatatgagaatacagagcatgttcaattaacacgatattttcttggacaaagagaaaaaatattagctgagctgttccgcgactaacatcgagttgatatgaaacgcgtttcatagcctatgataggtttatcaataattcaggagtgataaaaactatgatccaccagcatccagaatcttttccgaaacattttttgtgggctctgcttcagcagcgtaccagattgaaggcgcttggaatgaagatggcaaaggcccttctgtttgggatgtgtttacgaaaataccgggcaaaacgtttaaaggaaccaatggcgagattgcggttgaccattatcaccgatttaaagaagatgtcgctctgatggctgagatggggttaaaagcatatcgattttccgtcagctggccacgggtttttccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaatgaacagaactacaattttaatcacggatttattacagccatgcatccgcctggagtgaaagacagaaaacgattttacgaagcaaatcatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttatgaacaattggtggcttgacatgtattgctggggaacctacccgcaaattccattccgctacttggaaaaacagggatgggcgccgaaaatcgaagcaggagatatggagctgcttgccaaagggaagcctgattttataggtgtcaattattatcagacgatcacctatgaacgaaatccgcttgatggtgtgtctgaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgagaacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatacgatttaaaacgcttgaagaaaaaaagcttttattggtatcaagatgtcatcaagacaaacggagaaagtatataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttgtttcgtaggagtttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcgatagtgcacacctctgagtgcccctcatttatcgcatccttaatatgcttggccgtttcgggataacggtcagaagggaaggagattgtttcatcatattctttcgtttgagacgttttttgatcagctgagaaaaagtctccttttatcaggccgacagctgcagctgctatgatgacgatgacgagaagtattgtttttatgatgtccgtcgtgatgttcacctcccgcttttaaaactgacacaagagtaatccagaaagcatttggtgtaaaggtttaaattttatgttttacgctcagtttattgcaaaaatcgtaattttagcaggtcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatatgatgtgcactggctgaaatgtttgttacagatgctgataaatcactaatctcggcgctgatttcacctgttgcagctgcaatttccttaaatgcatctctggtgcgctggatcatggtgaccccttctgcagcttctgttttcacatgctcaacagatcttgcagaccggttcatatcattttgtatttctatgatcagttttgaaatctgccccgcagactgttgagactcttccgctaatttacgtacttcatcagcaacaacagcaaagccttttccttgttcaccggctctggcagcttcaattgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgcccaatgtctgcttttgattgcgcgagctgccctttgtcagcgatagcggcagtatttgcagaaatatcccggatgtctgctgaagcttgttttaatgagctttcactgttttcaattcgggtgatctgatcttgggctccatttgcaatctgctgtacagcttctgtgatcttttctgaagcttgatttgtttcctctgctccggctgagagctgctgagaggctgacgcaagctgaagggctgattgttgtacggtttgtatggtatcgttcagcttcattctcatcttattataatagacgcttagttctgatagctcgtcaccggttttgtctgacacctctattgtcatatctccgtttccggcactttcaaaggcgctttttaaagcgttcagccgcttgttgatttttctggtgaaaaccaagacaaggatgactgataccataatgacgataacaagaacgatagcgaattgagtgaaaagtgattgtgtaagtgatgttaaaatactttgattagctccggtatacagcatgccgatgatgttcccattttgatcttttaacggcatgtatgcagtctgataagaagaacctgctacatctgcttgtccgtaaaaacgctttcctttctttaaaacagcggcaataacttcagaagaagcctgggtgccgacagctctttcgccattcttcatgacattggttgcaacacgagtatcgccttggaaaatggtaatggtatcacctgttttttcgccaagcagatcaacaatatcttcatttccattgatttgtgtttgccctttatagagcttattgtttttcacctgccagtcgcctgacatgacatcatcaatataagtgctgcttaaagcgagatcacctttcgctttttcagttgccatttgtttcatgctttctgtaatttccttaagcatcacagtgccaactgatgccgaaaacaaaagaatcaccacgaaaacgaggcaaagaattttagttcctagcttcatctcaagtcgttttatcaacataattcctccctttatgatttgtaggtcatattacttatcgggtttttgggtttaaagttttattttagaaaaaataaaaccggcctgatcttcaggccggtttgtgtgatgctattcaaggtttgcgtggtgagtgaacatagtttcagaatcgagtccttttttctccatgagttttaaaatcactgcatcatagaatagcagcaaagtttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatgaatcaagctttttgtctcgcctgatcctgagccgataataactagatctcctttggcgagcggcggagtgagaatctcacctacaatatgggcgttgaagcccatgtgcatcagtctcatcgcgaaggattttgccatcaggccagaccgccccgcacccgcggtgaaaatttggtgggatgaaagaatgtgatcggcaagctggtcagcttcttcattagaaatataagctactgaattgtgtaactcattgagaatttccgctacgtattcagtcgttttcataggagttatccttggacaatcagctgcttcatttttgaagctgtttcagccttatcagctgcgcttgtaattccgcccccaacaatgacaaggtcagggttttgcttgatcacttctggcagtgtatcaagtttgatgccgcccgcgattgcggtttttgcgttttttacggtatttttgattgtcgttaattcttcgaaagagtttttgccctctgcttgaagatcatagccagtgtggacgcagatgtagtcaacgcctagtgcgtcaatttctttcgcacgggattcgatatctttcacgttaatcatgtccactaagattttcttcttttgttttttggcttcttctactgcgcctttaatcgttgcatcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattaatgacgaccggtgttccgatttcaactacgtcgatgtattgttctacctctttgacgagctcaatggcttccgggatgttgacgaggtctaatgcaagctgtaattccattgttgatccactccctttttcgaattatttttcattctataggttctcttatttgatgagaagtaggcactttgaagtcaacaagttacttggaggatactgtgaggagagacaatcagatttctttcgcttgattttatgagtgagtataatgaaaaaagagtctgcaaaaaaagtaagtaagtgatgatacgtatctaacatacaaaaaggttactaaggggggattctattgagccggatggacgacaaaaggtttaattgtgagaaggaattaacgcttgcagtgattggcggtaaatggaagatgctcattttatggcatttaggaaaagaaggcacaaagcggttcaatgaattaaaaacattgattcctgatattacgcagaagatcctcgtgaatcagctgagagagcttgagcaggatatgattgttcacagggaagtgtatccggttgtcccgccgaaggttgagtattctctgaccccgcatggagaaagcctcatgcctattcttgaagcgatgtatgagtgggggaaaggctatatggaattgattgatatcgacaaaaatgtcatgaaagaatcgttgtaagacgctcttcgcaagggtgtcttttttttgcctttttttcggtttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtgaacggtagtaagataaaaaatattgaaaacaatgaataaatagacaaaattgtttcctattaggataggggatcttgcggtctttatccacttatgttaaacgccgcaatgctgactggcggctgcccgttttaatagcggcaatctgtttttttgtttggaagctctgctttttaagtgtagtactttgggctatttcggctgttagttcataagaattaaaagctgatatggataagaaagagaaaatgcgttgcacatgttcactgcttataaagattaggggaggtatgacaatatggaaataactttttaccctttaacggatgcacaaaaacgaatttggtatacagaaaaattttatcctcacacgagcatttcaaatcttgcggggattggtaagctggtttcagctgatgcgattgattatgtacttgttgagcaggcgattcaagagtttattcgcagaaatgaagccatgcgccttcggttgcggctagatgaaaacggggagcctgttcaatatattagcgagtatcggcctgttgatataaaacatactgacactactgaagatccgaatgcgatagagtttatttcacaatggagccgggaggaaacgaagaaaccgttgccgctgtacgattgtgatttgttccgtttttccttgttcaccataaaggaaaatgaagtgtggttttacgcaaatgttcatcacgtgatttctgatggtatctccatgaatattctcgggaatgcgatcatgcacatttatttagaattagccagcggctcagagacaaaagaaggaatctcgcattcatttatcgatcatgttttatctgaacaggactatgctcaatcgaagcggtttgaaaaggacaaggcgttttggaacaaacaatttgaatcggtgcctgaacttgtttccctgaaacggaatgcttccgcaggaggaagtttagatgctgagaggttctctaaagatgtgcctgaagcgcttcatcagcagattctgtcattttgtgaggcgaataaagtcagtgttctttcggtatttcaatcgttgctcgccgcctatttgtacagggtcagcggccagaatgatgttgtgacgggaacctttatgggcaaccggacaaatgcgaaagagaagcagatgcttggcatgtttgtttctacggttccgcttcggacaaacattgacggcgggcaggcgtttttagaatttgtcaaagaccggatgaaggatctcatgaagacactccgccaccaaaagtacccgtataatctcctgatcaacgatttgcgtgaaacaaagagctctctgaccaagctgtttactgtttctcttgaatatcaggtgatgcagtggcagaaagaagaggatcttgcctttttgactgagccgattttcagcggcagcggattaaatgatgtctcgatccatgtgaaggatcgatgggatactgggaaactcaccatagattttgattaccgcactgatttattttcacgtgaagaaatcaacattatttgtgagcgcatgattacaatgctggagaacgcgttaacgcatccagaacatacaattgatgaattaacgatgatttctgatgcggagaaagaaaagctgcttgcgagggccggcggtaaatctgtgagctaccgtaaggacatgacgatcccggaactgttccaagaaaaggctgagcagctttcagatcatccggcggttgtatttgaagatcgtacattgtcctatcgaacgttacatgaacaatcggcacgcatcgccaatgtgctgaaacagaaaggggttggcccggacagtcctgtcgcggttttgattgaacgctctgaacggatgattacagctatcatggggattttaaaagccggcggagcctatgtgccgattgatccgggttttcctgctgagcgcattcaatatattttggaggactgcggggcggacttcatcctgactgaatcgaaggttgcggcgcctgaagccgatgctgagctgattgacttagatcaggcaattgcagaaggtgcagaagaaagcctgaatgcagatgtgaacgcacggaaccttgcctacattatttacacatcgggaacaaccggacgtccgaaaggcgttatgatcgagcatcgccaagttcatcatttggttgaatctctgcagcagacgatttatcaaagcggcagccaaaccctgcggatggcattgcttgcgccgttccacttcgatgcgtcagtgaagcagatcttcgcgtcgcttcttttgggacaaaccctttatatcgtaccgaagaaaacagtgacgaacggggccgcccttgctgcatattatcggagaaacagcattgaggcgacggatggaacaccggctcatttgcaaatgctggtagcagcgggcgattttgaaggcctaacactgaaacacatgctgatcggaggagaaggcctgtcatctgttgttgcggacaagctgctgaagctgtttaaagaagccggcacagcgccgcgtttgaccaatgtgtacggaccgactgaaacatgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggcgagctttatatcgcgggagacggtgtgggccgaggctatttacatttgcctgaattaacggaagagaagtttttacaagatccattcgtgccgggcgatcgcatgtaccggaccggggatgtggtacgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctgaaagcgaatttgcgccagccggcttgagggcgcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctttacagcgccgcgaaatgagactgaaaaagcaatcgcagccatttggcaggacgtactgaacgttgagaaggcggggatctttgacaatttctttgaaactggcgggcattcattgaaagccatgacccttttaacaaagattcataaggaaacaggcgtcgagattccgcttcaatatttgtttgagcatccgacgattgcggctcttgcagaggaggctgatcacagagaaagccgggcgttttcggtgattgaacctgctgaaaaacaggagcattacccgctttccctggcacagcagcgaacatatatcgtcagccagttcgaggatgcgggagtcggctacaacatgccggcagcagcaattctggaagggcctttagatattcaaaagctggagcgcgcatttcagggattaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggaaatttgatttggcgaaagctccgctattcagaatcggtttgctggggcttgaagagaaccgtcatatgctgctgtttgacatgcaccatttgatttctgatggtgtatccattggcattatgctggaggagttagcacgcatttataaaggcgaacagcttcctgaacttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacggggcaggatgacatcattgtcgggacaccgtcagcgggcagaaatcactccgatacagagggcattatcgggatgttcgtcaatacgcttgcgattcgcagtgaggtgaagcaggatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctgtccttgtctgttcatgagaccaatttcaagattgccaaatttgatttgacggtgcaggcgagagaaaccgatgaaggcattgagcttgatttggattatagcacgaagctgtttaaacaaagcacggcaaacaggctgcttacgcattttgcgcgtttgcttgaagatgctgcggctgatccggagaagccgatttctgagtataagcttctttctgaagaggaggctgcttcgcaaattcagcagtttaacccgggcagaacaccttatccgaaagacaaaacaattgttcagctgtttgaggagcaagcggcgaaaacgccagatcacccggcgcttcaatatgaaggcgaatcactcacttatcgtgagctgaatgaacgggccaatcgtttagcccgcggcattctttctcttggggctggcgaaggcaggacagcggctgtcttatgcgagcggtcaatggatatgattgtgtcgatcttggcagtattaaaatcaggttcggcttatgttccgattgatccggaacatccgattcagcggatgcagcatttcttccgtgacagcggagcaaaggtgcttctcactcagaggaaattaaaggctttagcggaagaagcggaatttaagggcgttatcgtgctagccgatgaggaagagagctatcatgccgatgcgcgaaatctcgcactgcctcttgattctgaagcaatggccaacctgacgtatacctctggaacgactggaacacctaaggggaatatcgtgacacatgccaatattctccgcacggtgaaggaaacgaattatctcagcattacagaacaggatacgattctcggtctttccaattacgtgtttgacgcgtttatgttcgatatgttcggatctttgttaaacggagccaagctggtgctgataccgaaggaaaccgttttggacatggctcgtctgtcccgcgtcattgaacgggagaacatcagcattctcatgattacaaccgctttgttccacttgcttgtggacttgaatccggcgtgcttgtcaacgcttcgcaagattatgtttggcggggaacgggcttcggttgagcatgtcagaaaagctttgcaaacggttggaaagggcaagctccttcacatgtatggaccgtctgaaagcacggttttcgcgacgtatcatccggttgatgaattggaggagcacacgctgtctgttccgattggaaaaccggtcagcaatacggaagtatacattcttgcccgtacgggacacgtgcagcctgccggaattgccggagagctttgcgtcagcggcgaaggactcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggagagtgttgtgcttgccgttgatcaaggagcgggagataaactgctttgcgcttactatgtcggagcgggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatgaaacggaacaaaaagtcgcagacatttgggcacaggtgcttcaggctgaacaagtcggcgtttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctccgctgaaaaagggacagccgcaagtatcagcccggcagagaaacaagatacgtatcctgtttcttcaccgcaaaaacggatgtacgtgcttcagcagcttgaagatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgtgagatagcctatttcgaagccacggaagaagagacagagcggatcgtttctgagtttattaagcctttcaaaatcgaccaacttccactgttcagaatagggcttatcaagcattcagacactgagcatgtgctgctgttcgatatgcatcatattatttctgacggtgcatctgtcggtgtgctgattgaggagctttcaaagctgtacgacggagaaacccttgagccgctccgtattcaatataaggattatgccgtgtggcagcagcagttcattcagtctgagctttacaagaagcaagaagagcattggctgaaggagctggacggagagctgccggtgctgacgcttccgactgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattggcgctgcgcacgtatccgaagggtgaaaagacgtttgccaactatcttaacgaagtgaaagaaacggcactcagcgcttttgatgcgcaggattacccacttgaggatttgatcggaaatgttcaggttcagcgtgacacaagcagaaacccgttattcgatgcagttttttcaatgcaaaatgcgaatataaaggatttaacaatgaaggggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcaccgagacagaaaagcaagcgcttcttgaggcatggaagggcaaggcgctgcctgtgccgacagacaaaacagttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctttacgggagatgtcattcttctcgacggaagccgcacgattctaagcctgccgcttgatgaaaacgacgagggaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgacgcttccatttgggagatgttcccgacttgggcgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaacaactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaagtggacaggcggcggcatcgaatacatcggccggatcgaccagcaggtcaaggtccgcggctaccggatcgagctctcagaaattgaagtccagctcgcacagctttctgaggtgcaggatgcggcggtgacagctgtcaaagataaaggaggcaacacagcgatcgcggcgtatgtcacaccggaaacagctaacatagaagcactgaaatcagcactgaaggaaaccctgccggattacatgatcccggcgttctgggtgacgctggacgagcttccggttacggcaaacggcaaagtggaccgcaaagccttgcctgagccggacatcgaggcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcttccagcacccgacgatcgaagagcttacccaatatgtagagcgtgccgaaggcaaacaggcagaccaaggtccggtggagggcgaagtcatcctgacgccgatccagcgctggttctttgaaaagaacttcacgaacaagcaccactggaaccaatcggtgatgcttcacgccaagaagggctttgatcctgaacgggtggagaaaacattgcaggcgctgatcgagcatcatgacgcgctccgtatggtctaccgtgaaggactggaagacgtcattcaatacaacaaaggtcttgaagctgcttcagctcaattggaggtcattcagattgagggccaagctgcagattacgaagaccgtatagagagagaagcggagcgtttgcaaagcagcatcgacttgcaggaaggcggtttgttaaaagcaggcttgttccaagcggaagacggagatcacttgcttcttgccattcaccacttagtggttgacggcgtgtcgtggcggattttactggaggatttcgccgcggtatacacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgttgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttcccgcacagtcggctggtttacaagtatgtaccccatggtgctcgatatgaagcatgcggatgatctgggctaccagctgaagcaaatgaaagaagatatcagacatgtgccgaataagggagtcggatacggcattctgcgctatctgacggcaccggaacataaagaagatgtggcgttctcgattcagccggatgtcagcttcaactatttaggtcagtttgacgaaatgtcggatgcaggtttgtttacgagatcagagctgccgtcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacatattgttcaaggtagcggttttccgccttgatgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagccaagcgtgctcccgggccgcctgcctgtgaaaaaagacgaatacgtcaataaagaatattcctttacatgggacgaaacattggttgcccgtattcagcaaaccgcaaatctccatcaagtgacagggcctaacctatttcaggccgtttggggcattgttctcagcaaatacaactttacggatgatgttgtcttcggaacggtcgtctcaggaaggccgtctgaaatcaacggaattgaaacgatggcggggctgtttatcaacaccattccggtgcgggtaaaagttgaacgagatgctgcattcgctgatattttcacagctgttcagcagcatgcagtagaggcagagcgttacgattacgtgccgctctatgagattcaaaaacgctcagcccttgatggcaatctcttaaaccatctggtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccgggcaaaacgtggaccgtcaaaattaaatataacggagccgcctttgattccgcttttatcgaacggacagcggagcaccttacccgcatgatggaagcagctgtcgatcagccggccgcttttgtgcgtgagtacgggcttgttggagacgaagagcagcggcaaattgtcgaggtgtttaacagcacgaaagccgaactccctgaaggaatggctgttcatcaggtgtttgaagagcaagcgaaacggacgccggcgagcactgccgtcgtatatgaaggaaccgagctgacgtaccgcgagctgaatgcagcggctaaccgtctggcgaaaaagcttgtcgaacaagggcttcaaaaaggggaaacagcagcgattatgaacgaccgctcagtagaaaccgttgtcggcatgctggctgttttaaaagcaggcgccgcatatgtgccgcttgatccagcgcttcctggggatcgtcttcgtttcatggcagaggacagctccgttcgaatggttttgaccggaaattcttatacagggcaggcacatcagctgcaagtgccggttcttacactggacataggttttgaagagagtgaagtggctgacaatctcagcctgccatccgccccgtccgacttggcgtacatcatgtacacatctggttcaacgggcaaaccgaaaggcgtcatgatcgaacataaaagcattctgcgcctcgtcaaaaatgccgggtacgttcctgttactgaagaggaccgcatggcgcaaacgggagctgtcagctttgatgccggaacgtttgaggtattcggcgcactgttgaatggcgcagcgctttatccggtcaaaaaagagacgctgcttgatgcgaaacaatttgctgcattcctgcgtgagcaaagaatctcgacgatgtggctgacatcacctttattcaaccagcttgccgcaaaggatgcgggtatgttcggcacactgcgccatttaatcatcggcggagatgcccttgtccctcatattgtcagcaaagtaaaacaggcatctccgtcgctttcattgtggaacggatacggcccgacagaaaacacgacgttttcaaccagttttctgatcgaccgtgagtatggcggctctatcccaatcgggaagccgatcggaaattccactgcctacatcatggatgagcagcaatgcctgcagccaatcggcgcgcctggtgagctttgcgtaggcggaatcggtgtagcgcgtgggtatgtcaatctcactgagctgacagaaaagcaatttctcgaagacccgttcagaccgggtgagagaatttatcgcactggtgacttggcaagatggctgccggacggcaatatcgaatttttaggcagaatcgacaaccaagtaaaggtgcgcggcttccgaattgagcttggcgaaattgaaacaaaactgaacatggctgagcatgtgacagaggctgcggtgatcatccgcaagaacaaagcggatgaaaatgaaatttgcgcgtacttcacagcggatcgtgaagtggctgtgagtgagctgagaaaaacactgtctcagtctttgcctgactatatggtccctgcccacctgattcaaatggacagcctgccgcttacgccaaacgggaaaatcaacaaaaaggaactgcctgcaccgcaatcagaagccgtgcagccggaatacgcagcaccaaaaacagagagtgaaaagaaattagcggagatctgggaaggaatactcggcgtcaaagcaggcgttaccgataacttctttatgatcggcggccattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaatcgatcaggcaagcatcttatcagcagcattatcctgtatccccggcccagcggagaatgtatattctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagaaataatcaaagaatttgttcagctgtttgaattaaaccgcgcgccgctcgtccgttcgaagcttgtccagctggaagaaaaacgctacctgctgctcattgatatgcatcatattattactgacggaagttcaacaggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggcctgctgaacggagctttgcgggagagcgcgtgatgtttgggcttgataagcaaatcacggctcaaatcaaatcactcatggcagaaacagatacgacaatgtacatgtttttgctggcggcgttcaatgtactcctttccaagtacgcgtcacaggatgatatcattgtcggctcgccgacagctggcagaacacatcctgatctgcaaggtgtgccgggtatgtttgtcaacacggtggcactcagaacggcaccaacgggagataaaaccttcgcgcaattccttgaagaggtcaaaacagccagccttcaagcattcgagcaccagagctatccgcttgaggagctgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccgaacgttcggctgtctgatgtagatctgctttcatctgcagaaacggctgctttgctagaagaaagacatatgactcaaattaccgaaacctttgcagcactttttgaaaaacaggcccagcaaacacctgaccattctgcggtgaaggctggcggaaatctgctgacctatcgcgagcttgatgaacaggcgaaccagctggcgcatcatcttcgtgcccaaggggcaggaaatgaagacatcgtcgcgattgttatggaccggtcagctgaagtcatgatatcgattctcggtatcatgaaggcgggggcagctttccttccgattgatcctgatacacccgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgcaatctgacaaactatgtctcttggtttagtaaagaggcgagcctgacggaaaatgataagactgtattgctttcatcttacgcatttgaccttggctatacgagcatgttccccgtacttctgggcggtggcgagctccatatcgtccagaaggaaacctatacggcgccggatgaaatagcgcactatatcaaggagcatgggatcacttatatcaaactgacaccgtctctgttccatacaatagtgaacaccgccagttttgcaaaagatgcgaactttgaatccttgcgcttgatcgtcttgggaggagaaaaaatcatcccgactgatgttctcgccttctgtaagatgtatggacataccgaatttatcaatcactacggcccgacagaagcaacgatcggcgccatcgccgggcgggttgatctgtctgaaccggatgcatttgcgaaacgcccgacaatcggacggccgattacgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgcggctaccgcattgagccgaaagaaattgaaacggtcatgctcagcctcagcgtaattcaagaagcggttgtactagcagtttccgagggcggtcttcaagagctttgcgcgtattatacgtcggatcaagctattgaaaaagcagagctccggaaccagctttccctaacactgccgtctcatatgattcctgctttctttgtgcaggttgacgcgattccgctgacggcaaacggaaaaaccgacagaaacgctttgccgaagccgaacgcggcacaatccggaggcaaggccttggccgcaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgccagctggcggcttatatggaggcgtctgccgtttcaggcggccatcaagtactcaaaccggctgacaagcaggctatgtatccattgtcatccgcacagaaacggatgtacgtgctcaatcagcttgaccgccagacgataagctacaacatgccatctgttcttctaatggaaggagagcttgatatttcgcgcctgcgcgattcactcaatcagcttgtgaaccgtcacgaatcattgcggacgtcatttatggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatctttgtaaaagaattggcgctgctttacaaaggagagcagcttccggagccggcgcttcattataaagatttcgccgtttggcaacatgaagctgagcaaaaagaacggatgaaggagcatgaggcgtactggatgtcagttctttcaggcgagctgccagagcttgatctcccgctcgattacgcccgtccgcctgtgcaaagctttaaaggagatacgatccgtttccgtacgggaagtgagacggcaaaggcggtagaaaaactgcttgcggaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagcaagcaaagcagacgaacttgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacggatctgttcgcaaaagaaacagctgaaaaatggagcgaatacgttctgcggctactaaaggctgttgcggataacccgaaccagccgctttccagcctgtcactggtcaccgagacagaaaagcaagcgcttcttgaggcatggaagggcaaagcgctgcctgtgccgagagacaaaacggttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgagtcggcgttctcacgaagccgtcgcttgaaatgtccgccgcggtgctcggcgtcttgaaagccggagcggcgtttgtgccgattgatcctgactatccggatcagcggattgagtatattttacaggacagcggcgcgagacttctcttgaaacaggaaggtatttcagtgccggacagctatacgggagatgtcattcttctcgacggaagccgcacgattctaagcctgccgcttgatgaaaacgacgaggaaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcggtatgacagaggaggaccgcagtgcgaagtacgcaggctttggatttgacgcttccatttgggagatgttcccgacctggacgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaataactacgggccgacagaaaatacggtcgttgccacaagcgcagaaatccatccggaggaaggctcgctttccatcggaagggccattgccaatacgagagtatacattctcggagagggcaatcaggtacagccggaaggcgtagctggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctctcagaaattgaagtccagctcgcccagctttctgaggtgcaggatgcggcggtgacagctgtcaaggataaaggaggcaacacagcgatcgcggcgtatgtcacaccggaaacagctgacatagaagtactgaaatcagcactgaaggaaaccctgccggattacatgatcccggcgttctgggtgacgctgaacgagcttccggttacggcaaacggcaaagtggaccgcaaagccttgcctgacccggacatcgaagcgggaagcggagaatacaaagcgccgacgaccgacatggaagagctgcttgccggcatctggcaggacgtgcttggattgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaggagctcacccagtacgtagagcgtgccgaaggcaaacaggcagaccaaggcccggtggagggcgaagtcatcctgacgccgatccagcgctggttctttgaaaagaacttcacgaacaagcaccactggaaccaatctgtgatgcttcacgccaagaagggctttgatcctgaacgggtggagaaaacattgcaggcgctgatcgagcatcatgacgcgctccgcatggtctatcgtgaggaaaacggggacatcgttcaggcgtatcaaccgatcagtgagagcaaggtcagcttcgaaatcgtggatctgtacggctccgatgaagagatgctgagaagccagattaaaattctcgcgaacaagctgcagagcagtctcgatctgcaaaacgggccgcttctaaaggcggagcaatatcgcacagaagctggagatcacctgctcattgctgtacatcatctggtggtcgacggtgtgtcatggcggattttgcttgaagactttgcttcaggctacatgcaggctgagaaagaagagagccttgtcttcccgcaaaaaacaaactccttcaaggattgggcggaagaactggcggcattcagccaatcagcgcatcttttacagcaggctgaatactggtcgcaaattgccgctgaacaggtttctcctttaccgaaggattgtgaaactgtgcagcggatcgtcaaggatacatcatccgtcctatgtgaattaacggaagaagacactaagcatcttttaacagatgttcatcagccatatggaactgaaatcaacgatattcttctcagtgcgcttggtttgacaatgaaagaatggacaaagggggccaaaattggcattaaccttgagggacacggccgggaggacatcatcccgaatgtgaatatctccagaacggtcggctggtttacggcacaataccctgttgtgctcgacatatctgaagcagatgcctcagctgtgatcaaaacagtcaaagaaaacctgcgccgcattccggacaaaggtgttggctacggcattcttcgttatttcacagaaacagcggaaacaaagggcttcacaccggagatcagcttcaactatttgggccaattcgacagtgaagtcaaaaccgatttctttgaaccgtctgctttcgatatggggcgccaagtaagcggagaatcagaggcgctgtacgctttaagcttcagcggcatgatcagaaacggcaggtttgtgctttcctgctcctacaatgagaaggagtttgaaagagctacagtcgaggagcaaatggaacggtttaaagaaaacctcctgatgctaatccgccattgcacggaaaaagaagacaaggaattcacaccaagcgactttagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaagacctgtccaagtcgtattaaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagccagccccccgtcaaaccgtataaagactacataaagtggcttgaaaagcaggataaacaagcatcactgcgttactggcgcgagtatttagaggactttgaaggacaaacgacgtttgcggagcaaagaaagaaacaaaaggacggctatgagccgaaagagctgctcttttcactgccggaggcggaaacaaaggcctttaccgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcagctgcaggagcaatcgctgcagtctgagccgcatcaatatgtgccgctttatgacatccaaagccaggccgatcagccgaaactgattgaccacatcattgtttttgagaactatccgcttcaggatgcgaaaaatgaagaaagcagtaaaaacggctttgatatggtggatgttcatgtttttgagaagtcgaattatgatctcaacctgatggcttccccgggagatgagatgctgattaagcttgcctataatgagaatgtgtttgatgaggcgtttatcctgcgcttgaaatctcagcttctcacagcaattcagcagctcatccagaatccggatcagcctgtcagcacgatcaacctcgttgacgacagggagagagaatttttgctaaccggcttaaacccgccggctcaagctcatgaaacaaagcctctgacggattggttcaaggaagcagtgaacgtcaatccggatgcacctgcgcttacgtattccggccagaccctgtcttatcgcgaattagatgaggaagcgaaccgccttgcacgccggctgcaaaaacacggtgcgggcaaaggctctgttgtagcgctgtacacgaagcgctcacttgaattggtgatcggcattctcggtgtattaaaggcgggagcagcctatctgccggttgatccgaagctgccagaggaccgaatctcgtatatgctggctgacagtgcggcagcctgtcttctgacgcatcaggagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatgaccactcatgccaatattcaaggtttggtcaagcatgtagactacatggcattttctgatcaggatacgttcttgtctgtttcgaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaaggggcttcgctgcgtgttattcggcggagagcgcgcgtctgtgcctcacgtcagaaaagcgctgcgggtcatggggccgggcaagctgattaactgctacgggccgactgagggaacagtgtttgcgacagctcacgtcgtgcatgatataccggattccatctcctcattgccgatcggaaagccgatcagcaatgccagtgtttatattctgaatgagcaaagccagctccagccattcggggcggtcggtgaactgtgcatcagcggaatgggcgtgtcaaaagggtatgtaaatcgtgctgacctcacgaaggaaaagtttattaacaacccgttcaagccgggagaaacgctttaccgcacaggggatttagcacgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgcttcccgcatcaagaaagagctcgggattgatcttccagtaaagcttttgtttgaagcgccgacgattgccggcatttcagcgtatttgaaaaacgggggccctgatggcttgcaggatgtaacgataatgaatcaggatcaggagcagatcattttcgcattcccgccggtcttgggctatggccttatgtaccaaaatctatccagccgcttgccgtcatacaagctgtgcgcctttgattttattgaggaggaagaccggcttgaccgctatgcggatttgatccagaaactgcagccggaagggcctttaacattgtttggatattcagcgggatgcagcctggcgtttgaagctgcgaaaaagcttgaggaacaaggccgtattgttcagcggatcatcatggtggattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcaacctgatcagcacaggccaggtgaaagcagatattgatctgttgacttccggcgctgattttgacatgccggaatggcttgcatcatgggaagaagctacaacaggtgtttaccgtgtgaaaagaggcttcggaacacacgcagaaatgctgcagggcgaaacgctagataggaatgccgggattttgctcgaatttcttaatacacaaaccgtaacggtttcataaatgaagtgatgaaaggaggagacagccaatgagccaactcttcaaatcatttgatgcgtcggaaaaaacacagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcgcaaaagcttgagcgtgaaggcatctttccgcaggcggttattatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattatcgggctcttgaacaatttgagctttacgatctggcccagatccagtcgcctgttcatgtctttaacgggcttgatgataaaaaatgcatacgagatgcggagggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgcttttttttatgttgaatgccaatttttgcatggtataatagtcgaaatacccaaataaaggaaggtcgaaacatgcgcacgtctcccaggatgaaatggtttgtattgctgtttacgtttgttttcgccatcggaatgaactcattcagaaattcctttcaattttttatgctgccaatggcggatgccttccatgccgacaggtcgctgatttcggtttctgtcagcatttttatgatcacaaccggcatcgtccagttttttgtcggtttttttatcgaccgtttcagtgtcagaaaaattatggcgcttggagctgtctgcatcagcgcaagctttttggtgcttccttattcaccgaatgttcatgtgttttccgccatttacggtgtgcttggcggaatcggctattcctgcgcggtcggcgtgacgacccagtacttcatcagccgttggtttgacacacataaaggtctggcgcttgctattttgaccaatgccaactctgcgggcctgctgcttctctcgcccatttgggctgcggctccgtatcatgccggctggcagagcacctatacgattttgggaatcgtcatggcggctgttctgctgccgctcctcgtctttgggatgaagcacccgccgtatgcgcaagcggagtctgtgaaaaaatcttatgattggcgggggttttggaacgtgatgaagcaatcccgcctcattcatatcctgtacttcggcgtgtttacttgcggatttacaatgggaattattgatgctcacctcgtcccgatactgaaggatgcgcatgtctctcatgtcaacggaatgatggccgcgttcggggcatttatcatcattggcggattattggcgggctggctgtccgatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcggcgtcaatttcggaaagccatcaaacaggattgatcggatcgctgttaggcatcaatttctttatccatcaggttgccggagctctcagcgtgtatgcgggcggtttgttttttgacatgactcatggttatttgctgattgtcgctgtgtgcatcgtgtttgtgggtttatcggctgtaatagagctggtgccgtttttagataaacaaaaggcaaaagaaacccaccaatcaatataaaaggatcagcactgtcaatgctgatcctttttaaatttgagtttttttgtttcggtatttttaaggataatctccttgaatctgttcatctccacttcggaatgaaaaaaatgttttgggatcgcaatatattggctgctggatgtattgatgcggaagatattcttatattcgaaaacagctgtgatttcattccaattgaaaatgaggtcatattttttagaacatatacgaattccttcttggttcagagtatatgttcttttagatttcatccgttcgttcttcttgtatgctctggaaaacttcacatatagaagcaggaggagcagcagtgtaaacagaactgacatcacgataatcaacatactgttcataaacaagttaagcgcgtcactgccataaacgatacggggccatccgttaatgaagttaactgcagcaaatatggcgcaaaacaatagaaagtaaaagcatgatatttttgcgatttgataaaaaaagatttctcttacatccttaaaagtgatttctcctggaagattgatattttcactagcatattgaatcatacggtaaacctacacctctaaccatgtttttcctttcagtctagcataatttttcatttttttgcaggcataccagggcgctttgtttttttctccagattgatattgctccccaccacgccaatcataatacaaacagccccggcaagatgataccaggccaggctttcgttgagaatcacaactcctgcaatcatcgtcacaatggtagatacatgattaaaagcgctcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgctccgtgacgcacaagggcgatggcgttgaagacgacaaagccgatggttgacatgatgtaggtgagctcggtcagcttgaaccgctgcgtcatttttctggcagcagtattgtacatcgctgaagacaaagcggacaaaaggatcagcaaagacccttttaagctggctgattccacgtcaacgcctttcatcacaaaaataaacatgacgccggcaacggataaaactgtgaatcccttttgcgtccacgttgggcgttcctttaaaacataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttacgcggattgatagctttacccagccgaataagatcggtacagtggccgcagcaaacgcaatggtgaaccgatgcgccaaaatatcaaacggctctgctgtttgcagtgcgattttcacgaatagaaaggataaaccgataatgaacgaatataaaatagccgctatataagcgggggcttgctgatgtttaaccataatgggaagtgctcctttacctgaattgcagcgccggtcgctccctttattgtatggccgcggtcagaacggtacaatgagaaaaacaatgaactgtaccggtacaaaacagggggagaaggcatggagaaatatatgagtctagtaacgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttccgaaaagcggctattatattgtgaaaaagacagggaaatcaaaaagcgggcagcctggccccatcgactttgccacatctgcgccggacccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagatcgccattgaacagccgggctaccatttgatggtcgaacagcttgagacgcttgggattcccgctatcggggtgaaacgaacggaagaagggcttgatatagccgaggttgagcggttatttcaaacagaatcgattaaatttttttatacgatgccgcgcttccataacccgcttggctgctcattgtcagagcgtgataaacaggagcttgtgagactggcagaagcgtatgatgtctatctcgttgaggatgattacctcggtgatctggaagaaaataaaaaggcagatccgctgtacgcatatgatctgtcctcacatgtcatctatttgaaaagcttctcaaaaatgatgttccccggccttcgcgtgggggcggctgttttgcccgaagcgctgactgacacgttctatgcgtacaaaaagctgaacgacatcgactgttcgatgatttctcaagcggcattggagatttacctgaaaagcggtatgtacggcaggcataaggagaaaatcagagattcttataaagagcggtcgctgaggctacatcaagccattcgaactcacaggcagctgggaagcggacgctttacgttctccagcgggcaggcaccctgtatgcacacccacctggtgcttcctcaggatctgcccgcctcaagagtgattcatagactgaaaaaacaaggggttctccttgaggcgatagaccgtcattatttatcagattatcagaaagaaaatctattaaaaatcaatatttccaatgtgaaaacggaagatattgagcacggtgtcaagctgttgatgagccatttataaaagctcttcgtacgagaccattgtgatatcctcggggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcgcaaatgacccagcgtccggagtgagaaatgttgaaatgagcgtcgggaagatcagggatgcacggcttcccgtattcctgtgtgctaaagcggatatcggatttgtccaactgatactgcctgcttatgactgagcgaacgagcacatctcccagcagggtgcggtgagcatcttctttatgataaaatctccggcatttctcccgtttttcaggtgatatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtgtacaggcggagatgctttcacagcggctgtccgccttgccacagcataattcagcagctggattgactggggcaatgaaaagcgcaaaataagtccggtgaggatggcggtcaaaatggtgccaaaaccgatcggtccgcccatgccccatgccgcaaacaaaatggttaattccatgccgttccgcacccattgcacattccagccggttttttctgtaatcagcatcatcagtgaatcacgcggccccgcgccaaggcctgctgatacataaacaccgacgccgtaaccaatcagcaccacgcctagagagaagacgatgatcgagcctgtgtaggtcgagggggcaggcagaatgaaattgaaaaaatctataaatacaccaatgagcaccatattcaggagggcaccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcgggcgccctgtttcagcgtgttggcaaacccttgcattcgttgtcaggcctgtgcttcggtgctcacgaatttaacattcgctgtgctccaatgctcgcccttcctagacttcaaaggttttcaatcacgctgaaaatcacaaaatcctaaaacgaaaatcgttttaggattttgtcaataatctgaaacagggcgctggcgccctgtttttcttattacagcgggttcaaaatccggttcaagaaccgctgtgtccgttcttcttttggtgcggagaaaatttgctccggcggtccttgctccacgataacgccgccgtcgatgaagatgacttcatccgcaacctcctgcgcgaacttgatttcgtgggtcacgacgaccatggtccagccttcattggccaagttcttgataaccttcagcacctctccgacaagctcgggatcaagcgctgaggtcggttcgtcaaacagcatgagctcaggctgaatcgccagtgcgcgggcgatgccgacgcgctgctgctggccgccggaaagctggaacggatataaatccattttgtccttcaatccgactttatcaagaagctgaatcgcttcttttctgacttcctctttgttccgtttttgcacctgaacagggccttccatcacgttttcgagggctgtgcggtgcgggaacaggtgatacgcctgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccgaatgatttcagatgcataggcgccgacgtttaatgaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggatcacctgtttcaaacgcgattttcacgtttttattgccagatgtttttaagtagttcaatacggcaagcttatcgttgtatgtcatatcgacacggccttgctggatcatttgaagggcctgcgccatgccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatatttgtcttcacgatctgtttttccgacttggttggcaacaacgtcaaaccgtttggaattcaggccggcaaacatactgtcccactgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccatctttggcattatcttttgactgattgtcatttcctgctccgcaagctgcaagagctgcaatacttacgaccatgaataaagccaataatgcttttttcatcttattccccacttttctggttgattttattgaaataaaaaattagcttacaaatctaaaggataacttttttttagtatgagtcaagtatttggttttcataagacaaaatcttttaaaataaatccaaaaattgctgtgccggtttaggcaaataactgtccgttctccacatgacagccggtgtcataatgaagggattattttcgatatggacggtgtgaacgtgatttctcatatgaacgggaatcattgtgacgggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtcctccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagttccaacagtgtcgcgggctcattttcccaaatattaaaggtgagatgggggtatctctctttgatctgtgttactttttcaagcatcagagccgcgcaataaattgttgaccccacggcaagtgtgccggctacctcctccttcagctcctgtacctcaatgactgcatcttcaaacctatgcagaatctcttttgctctttttagaaaaacagctccttcatatgtaagagtcatttgttttttcttgttccggtcgaacagaacaacaccaagttcgtcctccagctgtttgagctgcctgcttaaaggcggctgcgccatgtgaagctttttggctgcggacgtaattttctgttcttgggcaatggtaatgaagtatcgaagctggcgaatatccaaaagaaagcgcccccttatcataccttttaggtattaattatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacacgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggaatggcggataatctgctgacacgtgcggcggatgtcatgctcaaggagagaaaaaaactcgtcctcttaacgagagagacgcctttgaaccaaattcatctcgaaaatatgctagcgcttacgaaaatgggtacaatcattcttcctccgatgccggcattttataatcagccgagcagcttagaggaaatggttgaccatattgtattcagaacgttggaccaattcggcattcggcttcctgaagcgaagcgctggaatgggattggaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaattaaccaaggtgatggaggctactatttagacaaagcgtgtgtcatttcccgtgatcttgaagaccctgacaacttcggcaaacaaaatgtcggcatttacagaatgcaggtcaaaggaaaagaccgtctcggcattcagcctgtcccgcagcacgatattgcaatccatctgcgccaagctgaagaacgcggcatcaatcttccggtcactattgcgctcggctgcgagccggtcattacaacggcggcatcgactccgcttctctatgatcaatcagaatacgaaatggcaggtgcgattcaaggcgaaccatatcgcatcgtcaaatcaaagctgtctgatctggatattccgtggggcgctgaagtggtgcttgaaggtgagattattgccggagagcgcgaatatgaagggccgttcggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtatccgaacgaaattgtggcagtgaacgccatgtacacacacggtttaatcgcgattgtttccacaaaaacccgctatggcggatttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccggttgcgccggaaacaagaggccattattcacagccgcttgattctccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacgaatcccgaaaaatacaatccagcgtttaaaatagatccaaaggaaacagaaacagcaattgaagttccggcggtgccggaacgaaaggcttgatccgcgtgaacagtatgtcagaccgtctctttgagctgcttgacgggagatgcctgagtgagaagcagcatgaggccttcgttctgcaaacagtatcagaggatggctggccgcatgccgctatgatcagtgcaggtgaaattatcgcgctgagccgaactgatatccgaatcgctctgtggaaaaacacaatgacttcggccaacatccttcgcacaggaaaagcacagttcacggcatggtggaagggagcggcctattatgtaaagcttgaatgcgcgcctttaccgcctttgaaagatgccgaatatgaaagagaccgtttttcctgccgcatcgtttcagtgaaggaggacgttgcgaaatacgctgatttgacttctggtgtccgtatacagcttcacagccctgaagaggtgctgagcagatgggaaaagaccctggaagatttaaagcggtaatatcgatagcctgacgccatgcgtcaggctttttttatataatgaaaacaaagggggcgtgagaaatggaacgtgcggggatctgtcactcggacggctttgatttagcttatcgaattgagggcgagggcgcacccatccttgtgatcgggagtgcggtttactatccgcgccttttttcctcagatatcaaacagaaatatcaatgggtctttgtcgaccataggggatttgctaagcctaagcgggagcttcgtgcggaggattcggggcttgatgccgtcttggctgatatcgaaaggatgagagcatttcttcagacttgaggatgttactatcctgggacattccgggcacgcttttatggctttagagtattccaggacatattccaaacaagttcggaaggtggcgctcttcaatactgcgcctgataacagtgaagaaagacagcgaaaaagcgaatcatttttcatggaaacagccagtcttgagagaaagaaacgctttgaaaaagacatcgcgaatttgccgcaggacatcgaaaaagatcctgaaaggcgcttcgtgcacatgtgtatccgcgctgaagcgaaaagcttttatcaagagcggccgcatgctgctgccttatgggacggtgtattcacgaatatgccgatcatggatgaattatggggcaaaacatttgcccggcttgatcttattcagcggttagctgatgttcgtatgccggtgtatatcggattagggagatatgattatttggttgcgcctgttgcgctatgggatgctgttgacggtttatatccccatgtggataaggttatttttgaaaagagcggccatcagccgatgctggaagaaccggaagcctttgatcaaagcttcagcaaatggctggatcaataaaaaaacagcccgcagatcaaaatccgcgggctgtttctgattataagacccctttcatcgcgcgtttgataaccggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggggccagtttcgttgtcacggataaaccgactggagacaggcacagctctccaagcacgacaagcaggaagctgagaacgagccaaagcgggcttacgagtgcttcttttccttgcatagcagggaataccataatgataaatgacaatccggctaaaataattccgattgagaatttaactggtgtagacggctggcgtttgccaagcttcatccagagccatgcgaatattggcgcaaaaatgacgacaaacaatggatttaatgattggaaccaagatgactgaagttcgaatccgcccaatgaaagttttatgcgttcatcagcgtataccgcaagaatggtcgctccctgttcctgaatggcccagaacatgacagcaccgataaacaaaggaacgtaagcggcaagacgggatttttctgttttgtccgcttttttgcttgtaaacatgatgatgaaataaatgacaggaatcaaaataccgagaatacttacaaggtcgataaaacgcttgatcgtcagcacgcctgtttgtacagagatcatcactgcgatcgccacgatgataacaccgattccggtgccaatcgcagattttttagacagcggattcggcacattggaacctgcaagcccgaggtttttctttcttgtcaaagcaaatacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaatgataagcaccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccataatggaaaaattataaatacctaaaaatagtgattttctcctaatttttatactctttatcgtgagattttcttacacaactattcctttatatttttttaataaaattttagagaaatgtacaagcagatcgggcctttgtgagtaacatgatagtaatcatagagaaggaggctcgcaattggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcgggatcattgttcccggcaaccttgagattatgatggaccccgaatgtatcatgaaagtgataccgaatagttcgtggggttattccgcattttatgtaggcaagcaagagaatataactatttccggaggacaaattatcggcgaacgggatgagcatacgtatgtctcggcggggataaggtcaacccatgaatggggctttggcatatgtattgaaggatgctcgaatgttgtcattgatgatgtgaaaatttccgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggaatgcttgattgaagatgccggaacggggaatggaacagccccgaaattcggaattgacattgaaggatatggcgaaggtgacgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggaaatatactgaggcgccctgaagacgcggcggctgcgccaagagtcgggataaccggactcggtgtatcacaaggaaaagagaccagtgatgcagtgatcgctggcaacctcattaccggattttcaactggaattgatgtcaggggaaagagcgttcttgtgacgaacaacaaaatcagcaactttgaaaacacagggatattggtttatcagtcttccgacgtaaaggtagacggaaaccaaattcaaaacggactgtctgaaacaaggcgcagcatcggtcttcgcgcagtgctgtcagatgacatcgcttttctgaataactgtctcattcaagtcgttgacggtgtgaacgtttccggcggaaatatgatcattaaagataatctcctgagaaaattcagccggggcatttggattgctcaagggaacgcggtgattgaagggaatatactgaatcctgacgcgtttgaagcagtgccggaatcatattctgtttccgtcacaaacaatgccggcgccatcatcaaaaacaatacatttaaagagttcaaaaattaccccatttattgctccacaagtgcgaaaacctcaattatcggcaaccacttagagagatctccgcttttggtcaccatctatatcagcgccggtgtgcatgagatttttgataataccatttcagtcaacagaacagccgggaatccgattgtgatttatatcaatggctctgcaggctctatcgtctcaggaaacaccatcaataacctctccgcgggcactgcgacagctattcaaacaaacacgtcaaccaactccaaaatcatcggcaaccgcatttttaaagggacaatcaacaaacacagcagtgatgcaatagacggcaatattatcgtctgaaaaaagcgcccctctaggggttcttttttttcgatttatagatcacgtacatttctctcacaagtactaaaacaaaaaataaaattacaacccattccgcaaatgttgtcatcttaaagctggacatattgttataaacggcttttgttaaactgaacccttgaagcatgtccatcaatacagaaatagctaataaacaaattaatatgactccagtcacgcccaatatcttcatgcttcatcatcctccgcttttagtgtctatcgttggcggagaagttataccgcatctaaccctaatgcataatctcaattttaaaaggaagaatatgagaaaacgacaaggaaaggtatttgtgtatgcctttattttctaagcgaaagaacaataccgattcaaaagacaagcagaatacagacgaaaggaaccaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggtgtcattccgcggtccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaagcagcgcctggaaaaaatagatattgacagtattttggaatctggatatattgagcagctgattgaagatgaaacctttacgacgtttccgactatgtatcatacagaacgccctgatgtagtagcgggtaatctgttagaaggaagattcgcgattattgtggacggaacaccgtttgtgcttattgccccggccttatttgtccagttttttcagtctgttgaggattattattcgcgttttgacattgcgacaagcataagaattcttcgtgttttagtctttttcatttcgcttgtggctccggctgtatacgtggcagccacgacgtttcatcaagaaatgataccgactcagctgttagtggtcattgcggcccagcgggaaattgtcccgtttccggctgttgtggaggcgctgacgatggaggttgcttttgagattctgagggaagcgggattcaggctgccccgggttgttggctcggcagtgtcaatcgtaggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatttttattattgcctcagctgttatgggtttttacgggctgattttagggatcattatgatgtttgtccacttatgcagtcttcgttcattcggcgttccatatatgtcgccgcttgcacccttttcttcacaaggcgtaaaggacgcgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggatcagaatggtacgtaaatgtctattagccgttctcatgcttttgagcgccattgtgctgcccggctgctgggataagagggagctgacggatcttgcgattatctcggcgattggcatcgatcggacaaacgacagcaactacgtgctgcatcttcaaattatcaatccaggaaatgttgccggcggccttcagggaggcggtgctggagacaggccgcctgtatatgtctattcgattgaaggtaacaatataacggaagcactcagaaaagcctccatgaaggtatcacggcggctttattttgcccataccaatctagtcgtgatcaatgaaaagctggcaaaagaagaaggtttggattttgtattagataatcttgaccgggacacagaattcaggacaacagcaaccttcgtcgttgcccataaaacaaaagcagaaaatattgtgaaaatcctgacgccaattgataaaattccatcaaataaagtcaataaaaccttggatttcacggaggcgcaatacgggcgggtggtcaaaaccaatattcaggacgttttgaaaacacttgccgccaacactatggcaccggtcatccccggatatatgatgattggtgacgataaaaaaggagtcagcatggaaaacacgcaggcgactgacccgaaagccattcttcaggcagatggtctggcggtttttgataaggcaggatatttaaagtattggctggaagatgatgaaagcgtgggggcagtctggcttatgaataagatccagcatacgtttattaatgctgactggggcaagacgaaggatgcggtcagcttgcaggttacccatcaagatacaaagctggtaccgaaaatgcggaacggacgtccgtacatccatgtgaaagtgtcggttgaaggtattattgatgctgtcaaataccctttccaattgtctgatcccaaggtgctggccgctattgaaaaagcgctcaacaaagagcttgaaaaggaaatcagccatactgtgaaaaagattaagaagaataaaatagattttatcggttttggtgacacgatatatagaaagtatccggagcagtgggagaaaatgaaggacacatgggacaaagaatatttgcccgaactgcccatcgatgtgaaggccgagacgtatatcagaaggacgggattgcgaaacgatccgatcaaacaccagtttaaagatgattaggtctgaagaaaggggaagtgacagatggaaaaagccagaataagcataaggcagctgtttgtcatgattatcatttttgaactgggcagctccttattgattacaccgggatcaatggcgggcagggatgcttggatagcagttttattaggctgtgcgatcggactgtttcttttctatttgtatcaaggcatttatcaatgttatccgaattcttctccgaaagaatatatggatgatatgctgggaaccaagctgagctggctgttttcatttctctatatattgtactttgcctatattgccgcaagggtgctgcgtgactttggagaaatgctgctgacgtttgcttatcatgatacacctatcattattgtaaatgctttattaatggtagtaagcatatatgccgtaagaaaaggaattgaagtactcgcacgcgctgccgaacttcttttcggggtcatgtatttactgggcgcgatcgggctcgtgctgattattgtctcaggcactatagacccgcacaatttaaagccggttttggcaaacggtatttctcctatccttcactctgttttcacgcagaccatgtacgtcccatttggtgaagtcgttttatttgtgatgattttccctaacctgaatgacagaaaagatgtgaaaaaaatggggatgattgccatggctattagcggattggttgtggcgctcaccgtggcgattaatatcatcgtgcttgatgttgatcttacactcagatcccagttcccgcttttaagtacgattcagacaatcaaggtcgaagaatttttagaccggctcgatgtcttttttatgctggcgctgatcatcggcggcttctttaaggtcagcctctacttatatgccactgtggttgggacatctacgctctttaaggaaaagaatccctctcaattggcttatccgatgggattgggcatcttaatcctttctttaacgatcgcaactaacttttcagagcacttgaacgaaggcttgaacgtggtgccgctgtatattcatttgccttttcaattattgtttccgctctttctgtttattgtggctgtttggaaaaagaaacgaagagagaagtcaaaagggacaggagcaaaggaatgataaaaagagcggggggatgcagccgccgctctttttatgttcacttctatataaaagggggatatagggtgcgcccctgtctgcactggcagaggcgcgttttgttataccactgcgacgttttccttcacagtaaagcttcctcttgaaagtctgatattgatgtctgacacttttgcaatttgttcatcgtgcgtcaccataatgacgcatttattttccttgtgcgccagatcctgaaagagccgtacgatctcttttgatgtgtcctcatcaaggtttccggtcggttcatcggctacgataagatccgtgtcacagcagaaagcccttgtaattgatacccgctgctgctgtccgccgctcagtgtgagcactttttgccgggcttgtttttcgttgatgccaaccttctgcagcatgtcaagcgcatatgattctttgttcttttctttagatcctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgtgccgacgattgtgtagaattttcctttttgaaagctgatgttaatatcctgaaacaatggctggcttttgtctttataccagtagccgacttgttgaaattctaataagctcataggttccgcctctttctattcctgttttgtcaatatcgttttcggatgaagccgcagtactgaaattgacggcagcaatgttgcaatgattgcgattaggatgccgatcccgcccagaataagcatgtcgttcatagaaaccgcgacgttcagtgaatcgataacgtccacgtttgatgaactgtggccgaacattccgccgcccatgccgccaccgccgccgggcatttgtccgcttgcggtttgcgttgaatcggttgatgaactgatttgctgggataaaagctgatttccaagctgatttgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtctattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataagggtttaagaaagagaaattttgggcttggtcatcgcctgaagatgttgttttataaataccgacgatcttcagctttaccgtcgtatcttcatctgttgctgattcaattgtgatcgaatcgccaacgctcaaatcattttcttccgctaaagtttcgttgatcactgttacttttttgccgacatctgattttgtaatcgcgcgtccgtctgtgatttttgaatctccgtcagagaaatcatcgactaacgctgtgctgatgacaccttcaatcgaaagatcggcttgaaccatttgcggtccgccttgtccgccgccttggctgtttttagcgtttgagcttgaactgctggagctggaatcacttgaactagagctttcaatcgcatcaaagtttcccgcgttggctgaagctgatgtggtgtaattgtagctcttcacatgatcaagcgctgcaagcttattcgcatcagacactttgatcggtgtggattcgaagctgcgtttttcaccgctgtcctgctgtttttccatttgcttttggcggtcaacctgtagtgtcacgcttccgccgagttcctgtctggccagttcgcttgatttttgtgctgccgactggatggtgaggcctgatagaacaaagacacatatgactgtaaacacaaataattgcaataatgtttttccctttttagccttcatattccaaaaggcccgtttgataaagttcatttatgttcctccgtataggtactttgattgataaggccgcctctggggcgggcttgcttgttgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaatcggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcggctttgagatgggggcggacgattatgtcacaaagccgttcagcccgctgacattggttgcccgcatcaaagccgtcatcagaagatataaggcgacaggcaaagcggttattgatgaagatatgatcgaaacggaatgctttaccattaataagaagacgagagaagtattattaaacggagagcctgtagaaaatctcacgccgaaggaattcgatctgctttattaccttgtccaaaatccgcggcaggtgttctcaagagaacagctgcttgagcaggtatggggctatcaattttatggagatgagcgaacagttgacgttcatatcaaacggctgcggaaaaagcttgccagcgaagacaagcctttcttgtatactgtgtggggagtagggtataaatttgatgaagattaaatatttatatcagctgctgctaagccacatcagcattttgattttagcgtttgtcattatcatttctctgttttcccactttgtgaaagaatttgcctatcaaaacaaagtagaggaattgacgtcatatgcggtgcagatcgcaaatgaattccaagccggccaggtggacatgcgcaggctctatccttatcaggacattttaagcacaagaaagacgcaatttatcatctttaatgaagagcagcagccttattttcttcctgaaggctttcatcacccaccaagggaacagctgaagaaatcagaatggaataagctgaaaaaagggcagactgtcatgatcagggcagatggccgttttgatgatgaagtgtcccttgtggcgcagcctatatttgttcagaacgaatttaaaggcgccgttctgctgatttctccgatcagcggtgttgaacagatggtcaatcaggtcaacctctatatgttttacgctgtgatcagcacgcttgtgattacgattcttgtgagctggcttctgtccaaattccatgtcaagcggattcaaaagctgagagaagcgacagataaagtggcttccggcgattatgacatccatttggaaaacagctacggggacgaaatcggcgtactggcgtctgactttaatatcatggcgaaaaaactaaagcagtcaagggatgaaatcaatcgccttgagaagcggagaaggcagtttatcgctgacgtgtcacatgaattaaaaacaccgctgacgacgatcaacggtttggttgaagggctgaacagccatacgattcctgaggataagaaggataaatgcttctcgctgatcagtgaggaaacgaagcgcatgctgcggctcgtaaaagaaaatctggattatgaaaaaatcagatcccagcaaattaccttgaacaagctaaacgttcctctgatcgaggtgtttgaaatcgtgaaagagcacttgcagcagcaggcggaagaaaaacaaaacaagctgatgatccaggtagaggatcacgtcatcgtacatgccgattatgaccggttcattcaaattctcgtcaacattacgaaaaacagcatccaatttacgaaaaacggtgacatttggctgcgcggaatggaaggttataaagagacgattattgaaattgaagacacgggtatcggcattccaaaagaggatattgagcatatttgggagcgattctataaagcagatatttcaagaacgaacacggcatacggtgaatacggactcggtctctcgatcgtcaagcagcttgttgaaatgcaccagggcacagtagaaatcaagagtgaagaagggaaaggcacaaagttcatcatccgccttcctttaacggcaaaacagcaatagcatacagggcggcggcatcatctgatggagccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaaccaggcagatctcaaagggctgctcgactattacgtgaatttttttcgcgggatgtatgagtttgataagcgggaatttatttctgccattacatactataaacaggcggagaaaaagctctcctttgtcgcagaccatattgaacgggctgaattctattttaaaatcgcggaagcttattattatatgaagcaaacgtatttttcattgattaatataaaaaacgcctatgaaatttacgtggagcaggaaacctataatgtgagaatcattcaatgccatttcgtgttcggggtcaacctgatggatgaaagaaatttcgaacaagccgcacgccatttcaaattggcgctcaatatggcccaagcggaacaaaaagcccagctggtcggaagagcatactacaatctcggattatgctattacaatcaagaccttctaggccctgccattgattactttgaaaaagcggtctccacgtttgaaagcagcaggatcatcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatcaggatcagcccaatgaagaaggaatcgaacgatgtttccaatacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcatttgcgagaaggggtttttcttttcaaaaacaccgcaagacatagtcttgcggtgccgccttcatggagattacgtttatttagtagcctcctacaaatgcagttcccacaatgatcaagaggataaataacacaacaatcaaagcgaaagaagttccgtaacctgacattttgtgcacctccttgcgagattgcttcagcaaatgctgcaaaaccgtggcggacagggtcccgcagagacggtcagcagcttagtagccgccaacaaacgcagtccctacgataattaaaagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaacaattcggctatatgaaggtgatataaaaaatagcgggcgctgccgcccgctatttatgtacgattaagagattaatacgcccgcgaaaaattcctggtataacgcttgaacggcttttctttcttcggcttcttttacgccaaacatcatgctcacttcagaagacccctgattgatcatttcgatattcacctgtgcctctgataatgctttggcggctcttgccgttgtaccgacattgtggcgcatcgcttcccctacaaccataatcagggcgagatgatgctccacgatgacttcatcggcatgcaaatcctcttcgatccgtttgatgacgctgcgttcagtggcggcattcatttgcccctgccgtaaaatgatcgtcatgtcatcgattcccgagggaacatgctcatacgtcaaaccatgctcctccaggatttgaagggctctgcggccaaaaccgatttctctgttcatgagatatttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaaacccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccggcatccttcgggtttacatactccgctttgacgcctttatagcggaaataagcggcgatcagcttggcattgttatcctctccgctggccttgactgcgtcaaggtattgttcgggattgcttttatctccttctaaaagcgtaaacagatcatctctgattttttcgataatgccttgccccagctgaagctcagtggcgatgagagcgtaccgttccacaaccgcttccgccagttcaggtgcgctgcctgatgccaaatattgttctgcacatgcgattaagagatcagtcactttcgtatcctcggcatagcgttttcccggagctgaaacgactacagctttccgtgccgggtctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaaggggaatttctttctggagagaacatttgtatttttcacaaggaataatgtcaggtttgctgaccgtatgcctgcgttataaagataaatatggtaaacagcctaacgttttgggatggaaaatggttagaatgattagtaaaatggataaatgactaggttaatatttttaaagaatattgactaaccctagaaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcatcgcgggattaagcatgagcatctgcggtttgattatgcagcagattagcagaaataaattcgtgtcaccgacgacggcgggcacgatggattgggcgaggctcggcattttaatttccttgctgctgtttacatccgccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctcaagtacaaacgggttgtgaacatcgggctcattatcgtgtccctgatcacgtctcttgtcattttgactgtcggtatgctgccgtttctcggtttaatcatcccgaatattgtatcgatttacagaggagacaatctgaagagcagcctgccgcatactgcgctgttaggagcggtgtttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtattggcttgtttttgttttatgacttaggcaattgggattacaccctgccgagacgaatcaaaaaggtcgcagccattgtgctgactgggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggagggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacgtagacggacaagagattggagcatgtgacagcaaagagcttgccaagaaaatgagcattttgaagcaggcgaaccaaatcaatatcaggctcacgatcaaagacctcgttagttttggcaggtttccgtactcacagggccggctgacagaggaagactgggttcatatcaaccaggcgctcagctatatgaagctggaagacattcaagacaaatacttggatcagctgagcggcggacagtgccaaagggcatttatcgccatggtcattgcccaggacacagattatatttttctggatgagccgctgaacaatctggatatgaaacactcagttgaaattatgaaactgctgaaacggctggtagaggagcttggaaaaacgatcgtcatcgttattcacgatatcaattttgcttcagtctattctgaccatatcgtcgctttgaaaaacggccgaatcgtaaaagaaggaccacctgaagaaatgatagaaacatcagtgcttgaggaaatctacgatatgaccatcccgattcagacgattgataatcaaagaataggtgtctatttttcttaatatatagaagaggtgaagagcatgaaaaagttcgcattactattcatcgctttggtgacggcagttgtgatttctgcatgcggaaaccaaagtacaagcagcaaaggttctgattctaaggaagaacaaatcacggtgaaacaccagctggacaaaaacggaacaaaagtaccgaagagccctaaaaaagttgtcgtatttgactttggaagcttagatacattagataaacttggacttgatgataaagtagcgggactgccgaaacaagcccttcctaaatatctgtccaaattcaaggatgacaaatatgctgacgtcggaagcttaaaagagccagacttcgagaaagtggcagatttagatcctgacttgatcattatctcaggaagacaatctgagtcttacaaagaattctctgaaattgcgccgacaatttaccttggcgtagacacagcgaagtatatggaatcatttaagtctgacgcagaaacaatcggtaagatcttcgataaagaagatgaagtgaaggatgaactcgcaaaaatcgatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtcacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaagaatgtaaacgcagtgaaaaatgatcatgtcgtctaccttgattctgctacttggtacttatcaggaggcggtcttgagtctatggcacaaatgatcaaagaagtgaaagacggtttagaaaagtaaaaccaaaaagagcctccgctaaatagcggggctctttttttgttaatcagcgtgccggctgctgttcggcagggcgctgaggtttctttaatgtgaatgagagaaggaagccgacaagtgcaatgacggcagccactataaaagcggcgttcatgccgtgcagggcggcgtgcttcacatttgtcgtgcctgcatgtgcggcctggttgctcatcacggaaaccaatagtgcggttccgatcgagccgccgacttggcgaatcgtgttgttcatcgcagttccgtgcggaatcaagtggcgcggcagcgcgttgattccggctgttgtcactggcatcatgatcatggcggtacctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaagctgaaaacgccaaacgtgaagacgcggaattccagcatcggtttttcaagcttcatttgtcttgtgataaacaagagcagcgcgatgacacccaccagcagtgaaatcaagacggttgaactggaccagccataagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgtttttcaatcggaaagattgtcaggaatacagtctgcatgagcggcatcataatgccggctccagccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttagttaacataaatgatgtggtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttttgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatggcagctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcatgccgtgaagaatgataaccaaatcccacacaaacgggagaatggtttctccatacgcctggatcagcgaatcgcggtgccagcagataatcgtcgatctggtctgatggatatgctgtttgacccggtcattgtgcagcttggggtttccgtaggtcagcatattgaaaaactgctgattccgcctgaagccctccagttccattttgaccttttgcgtcaaacgctcctccggtgtaagtgcggtattttcctgaagtcttgaggccgcggccaccatttgcttctggttaaatgacagcagctccaaaagcagatcttctttagattggaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaactatgaaaaaaattttaccaaataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccaatttcttgtttcttttccgtttgtccgtttattcatgtattcagacatctgttcgtcgtatgcctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaaccgcaccgatcggaactgtgccaagtccgagtgactcagccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcgatccatggctggccgcctgccagttcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcatatgagacacccttcctttactcgctaagctctgtgcggacaacatcaagaggagcgctcagcagttcttttccttttgcgacaaacccttggaaatgtgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatgtaaatctcctccgtcgttatgcgaatttattgttcgaatttcatcgaactaaatgtaacatgtattctaaatgaggtaaaggaaaaacccttaaatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcaggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaacagctttgaaaagccgctgcacaccctcctgaatatcttcttccttcagccgtgcaaagccgataatgagagcaggcctgcccgtttgccgcttgttttccttcaagttaaatcggctcattccgaatatttcaagctgcagcccggcagcatgtgacaggatgtcttgttcggtgcgcctggtatcaaattcggtaacaaaatgcagccccgcatttgccccttttacggtaacctctccgctgaactctgcttctaaagcggtgatcaggcgttctctcttttctttataatgctgcatcattttttttatatgcttctgatattcaccagactcgataaattcctgcagggtgagctgtgtaagtgatgagcaagtctgcagatcatagccccgctgtttgtatgccctcaacagctcaggcggcaacaccatatagctgatccgcaagccggggagaagggactttgaaaaggttcccatatagatgacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcccttttcatccagcatgatcgtcttgacttgttttccggcattcttcaaaagctgatacatgcgcctgtagccaggctcctccatcgcatacacggcttcattgggtaaaagctcagtcaacagctgcatgagcacctgtgtgcctgcccctatgatcatttgttccggcctgcattttacacccctcgtcagggaaatgagcctcgtaatggccgctctcacttcatatatcccttgcggatgtgacatatcgccgagcgtgcggtatgagcgggaggccgctttttgctcgcagcggaaccagcttttgatcggaaaatggtctgtatcggaactcatgtgtgaaaacgatatccaatcgctctggtcgatgtgaatctcttttagatcatccggcagtgcaaatggagggtgctcctcggcggaaaacatgtctagttcctccacgaagaaaccctttcgttcaatggcgtacaaatacccctcagccagcagctgctgataggctgaattcactgaatttacgctgaccttgagattttcagccagctcccgcttggagggaaccttcgagtgcggcagcagattgcggctgaggatttcttttttcagcttttgataaatttgctgatagatataatcggcttgttctgaacgatcgagtgtaatcgtgatatccatttgtattttctccttctgataccatcaaaaagttataattggtacttttcatcataccaaagagaagtcagaatgataagaaaataccgacagggggatattcacatgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgccatcggcacgttaaatgtcggacattcgcatccgaaggtggttgaggctgtgaagcggcaggcagaggagctgattcatcctggctttaatgtcatgatgtacccgacttatatcgagttagccgaaaaactgtgcggcattgcaccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccggtgcagggagaaggcgggtttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatccagacacgcgtgagcctgataaagcaaaagcagcagcgatcgcggcctatgcgaatcaaaacggattacttttgctgacagcgggaattaacggtaatatcatccgctttttgacaccgctcgtcatttcagacagccttttaaatgaagggctcagcatcttggaggctggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgaactgattgttgaacataaagaagagcttgcagatttaattacgaaggaaaacggaaaaccctatcaggaagcagtcggcgaggtactatacggcgcaggctatatcgaatggttcgcagaggaagcgaagcgtgtgtacggaagaacggtcccggccccgacaactggtaaacgaattgttgtcacacgccagccggtcggccccgttgctgctatcacgccctggaatttcccgaatgcgatgattacacgcaaagcggcgcctgctcttgccgccggctgtacatttatcatcaagccggcgccggacacaccgctgtctgcttatgaactggcgcgcctagcatatgaagcgggcattccgaaggatgttcttcaggttgtgatcggcgatggagaagaaatcggaaatgtgttcacaagcagtccgaaaatccgcaaaatcacgttcacaggctcaacacctgtagggaaaatccttatgaaaaacagcgcggacaccgtaaagcacgtctcaatggagctcggcggacacgccccgctgatcgtagatgaagatgcggacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggcccgattatcaacaaacgaggcttcgaaaaaatcgtcagccaaatagatgatgcggttgaaaaaggcgcgaaagttattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagctgttcaagcgccattcggcggaatgaaagaaagcggcatcggccgtgaaggcggttcagaaggtatcgagccgtaccttgaaacaaaatatttgtccatcggtttataaaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcgctcattgtttctatcgttatttacttttttgttcagcccgttctgtcccttcgcatttttattgttggaatcgtatccggcttattttggtcacttggacaggccaaccagctgaaaagcattcaattgatgggcgtgtcgaaaacaatgccgatttccacaggaatgcagctcgtttccacctcgctgttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcgggggggtagttttaacctataggcacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggtggcattttcatcctgcgtgaaaagaaaacgaaacgccagcttatagcaattgcgatcgggattatcctgattattgccgccgccgtattcttaggaatcgccaaaacaaattcataacaaatggaggaggatgtatatgtatccggatttaaaaggaaaagtcgtcgctattacaggagctgcttcagggctcggaaaggcaatggccattcgtttcggcaaggagcaggcaaaagtggtcattaactattatagtaataagcaagatccgaacgaggtaaaagaagaggtcatcaaggcgggcggtgaagctgttgtcgtccaaggagatgttacgaaagaggaagatgtaaaaaatatcgtgcaaacggcaatcaaggagttcggcacactcgatattatgattaataatgccggtcttgaaaatcctgtgccgtctcacgaaatgccgctcaaggattgggataaagtcatcggcacgaacttaacaggtgcctttttaggaagccgtgaagcgattaaatatttcgtagaaaacgatatcaagggaaatgtcatcaacatgtccagcgtgcatgaaaggattccgtggccgttatttgtccactatgcagctagtaaaggcggaattaagctgatgtctgaaacgttggctttggaatacgcgccgaagggcattcgcgtcaacaatatcgggccaggtgcgatcaacacgccaatcaatgctgaaaaattcgctgaccctaaacagaaagcagatgtagaaagcatgatcccgatgggctatatcggcgaacctgaggaaattgccgcagtggcagtgtggcttgcttcgaaggaatccagctatgttacaggcatcacgttgtttgcggacggcggaatgacgaaatatcctgctttccaggcaggccgcggttaaacataaaaagcgacccagacatgacatctggatcgctttctttattaggcacgctttttctttacaagtgctgctacagataaaataatggcagccgcagacagcacaatcgctgtaatgtctagagctgaagaacctgagttttcggaatcgtcttctgttttcgtggccccgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactgtccttcctgaatgcctccgtcagtcgcctcccatgtcacggacactgatttgtcatcatgtttttgagtggaaaccttccagcccggaattggctcatattgctggaattcaacatccttcggcattttgaggacaaccttcgttgtcggcagatttttctctgaaggaaccttcattgtatacgtttcccaagagcctgcagcagactcagccggttttacagaaacatgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgatcctggaagacgccttttgttttttcttttaatgtaaaggtgcttttgttttcgctgcctgacagacctgttttataaacggttaacgtgatttgctggatgtttttcacgggatctccgttatggtcggtgacacgcagctcaaaaacattttttccgggctggtttgggctgatgctgagagaaacgctttgtccgttctcaattgctttggtttggtagaacggttccggcgctggctcaggcgggcttggcaggcttgtaaacacggccgctgtgatcaatacagcgatgccgattgcccactccgctttcaacgttcggctgattcctgtgcggcgctgctttctggtaagcagaaaatgaattgcgcctaagaccagcatgaaaacaaacagcccgcttttcactaaaagagcttggccatacgctgtatggaacagtgaatccattgaacgaatgatgaaaaatccattgagcaagcctgaaaacaaaatgacgccgactgcagtgagcgcccatggagagaaccgtctgaccgtctcccacgcgagcgttttgtcaggctgcctccattcttttgagagcagcaaaacgagtgccgctattccgccgacccagatggaagcggaagttaaatgaaggaaatccatcaaaatgccgaccgttttttcttcaacgacagcagcatgcccggtaaacgccttggcaagcaggagaccgaaaaagaaaatgagcggcgctgtccaatagccaaaggatgaaaagcggtttttccgtatcgcaggaattacagacagtgcgagcagcacgaacagcgcggcctgtatgatccaaatggagccgcctgctgtctcaaacagtgtttctctgatgtagcccggctggaatgcgctgccccagccgccgcctgcgttcgcttttgtctgaatcggaagctgaagcaaaagcgccagccccaatgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagagctgaatcggctgctttttggctgctgaatccgccatccgctttcccgatactgaatggaatgacgccggaaacaggatgcccgtccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgtgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagcgcttggtcgaaagtgcggacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacctcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatccgtttgaggtgttcgggcggggagcgtgatgccgccggccgttttaatgacctcatttgactgaaccagctgattgacatctctgtataccgtcatttccgaaacgccaaaccttgcgctgatgtcagaaattctgagcgcgccttcttctttcagccacttcagtatgtgttgttgtctattaatcggaagcattcatacaccctcttcattaagatctatttaagcgtagaggattttagagacagagacaagtaagctgatgataaaaaatgtgaaaatatgttgaacagcaacaaaacgaaacagaagggactctggtataatagacatatggaatagaaagtgaggaataccctatgaaagaaacaccatgcccgaactgcggcaaacctttgacaggcgacatggtcagatcatcaaatgtgccttgtcaatttcgctgcggacactgccgggaacggctttatgaatataaagtatcagctccgattatgctggtatcattagcggccatcgtgctgctcatttatcttttgctgctcctccgcaatgcggcaggttcaatgctgccggctgtacagcacgtgccaatggctgtttttgcgcttgtgtgcgcctatcccgtttttattgtgagtgagcgaatgatcgcaaagtacgtgattcaaaacggcaacattatttatagaggaaagagaaaaggctcctgaaaccaggagcctttttatttttaaaaaattgtcacagtcatgtgccaaagtcctctttactttcaattgtatagggactgtaagcgttttaacatagagacaaagggaagcatcattctctgaacatatttttgcaccttacagcgacaaacaaaacagggagggtttatatatgcagcagcaagaacagcagcaaggcggcatgaaagtgaaagtgcagcgctttgggagttatttgagcggaatgatcatgccgaatatcggcgcgttcatcgcgtggggtatcattaccgcgctgtttattccggcaggatggtttccgaatgaacagttgaacacgctggtcagcccgatgattacgtatttattgccgcttttgatagcgtatacaggcggaaaaatgatctacgaccaccgcggcggagttgtcggagcgacagcggcaattggggtgattgtcggatcggatattccaatgtttttaggcgcaatgattatgggtccgcttggcggatacctcattaaacagactgataaattattcaaggataaagtcaaacaaggctttgaaatgctgatcaacaactttacggcagggattgtcggcgcggctttaacgattctcgcgttttacgccatcggcccggttgtcctgacgctaaataaattgctggcggctggtgtggaagtcattgtacacgcgaatttactgccgatagccagtgtttttgtagaaccggcgaaagtgttgttcctcaacaacgctattaaccacggaatcttaagcccgatcggaatcgagcaagcatcccaaacaggaaaatcaattctgtttttagtagaagcaaaccctggaccggggctcggcattttgctggcgtacatgttctttggcaaaggatcttcaaaatcaacggctcccggtgcggcgatcatccatttcttcggcgggattcacgagatttacttcccgtacattctgatgaaaccggccctgattctcgcagccattgccggcggagcaagcggactcttaacgtttacgatctttaatgccggacttgtcgcggcagcgtcaccgggaagcattattgcattgatggcaatgacgccaagaggaggctatttcggcgtattggcgggcgtgttggtcgctgcagctgtatcgttcatcgtttcagcagtgatcctgaaatcctcaaaagcaagtgaagaagacctggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcggagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgatactcatgcaagtactcgcaaaggaaaatattaaactcaatcaaacggtatcatcaaaagaagaggccatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacaaattccagagggcgttgagtacggagaaggcaacacggcaaaagtggtattcggcattgcgggtaaaaataatgagcatttagacattttgtctaacatcgccattatctgttcagaagaagaaaacattgaacgcctgatctccgctaaaagcgaagaagatttgatcgccattttcaacgaggtgaactgacatgatcgccttacatttcggtgcgggaaatatcgggagaggatttatcggcgcgctgcttcaccactccggctatgatgtggtgtttgcggatgtaaacgacacgatggtcagcctcctcaacgaaaaaaaagaatacacagtggaactggcggaagagggacgttcatcggagatcattggcccggtgagcgctattaacagcggcagtcagaccgaggagctgtaccggctgatgaatgaggcggcgctcatcacaacagctgtcggcccgaacgtgctgaaactgattgctccgtctatcgcagaaggtttaagacggagaaacgctggaaacacactgaatatcattgcctgcgaaaatatgattggcggaagcagcttcttaaagaaagagatatacagccatttaacggaagcagagcagaaatccgtcagtgaaacggtaggttttccgaattctgccgttgaccggatcgtcccgattcagcatcatgaagccccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtcacagcgtatgtcggctatcagcgcggactcaaaacggtcaaagaagcaattgatcatccggaaatccgccgtgttgttcattcggcgctgcttgaaactggtgactatctcgtcaaatcgtatggctttaagcaaactgaacacgaacaatatatcaaaaaaatcatcggtcgctttgaaaatcctttcatttcggacgatgtgacccgcgtagcgaggtcacctctcagaaaactgggagaaaatgatagacttgtaggcccggcaaagaaaataaaagaaccgaatgcactggcggaaggaattgccgcagccctgcgcttcgatttcaccggtgaccctgaagcggttgaactgcaagcgctgatcgaagaaaaaggatacagcggcgtacttcaagaggtgtgcggcattcagtcccatgaaccgttgcacgccatcattttaaagaaactaaatcaataaccgaccacccgtgacacaatgtcacgggctttttttactatctcgcaatctagtataatagaaagcgcttacgataacaggggaaggagaatgacgatgaaacaatttgagattgcggcaataccgggagatggagtaggaaaagaggttgtagcggctgctgagaaagtgcttcatacagcggctgaggtacacggaggtttgtcattctcattcacagcttttccatggagctgtgattattacttggagcacggcaaaatgatgcccgaagatggaatacatacgcttactcaatttgaagcggtttttttgggagctgtcggaaatccgaagctggttcccgatcatatatcgttatggggactgctgctgaaaatccggagggagcttgagctttccattaatatgagacccgccaaacaaatggcgggcattacgtcaccgcttctgcatccaaatgattttgacttcgtggtgattcgcgagaacagtgaaggtgaatacagtgaagtcggcgggcgcattcacagaggcgatgatgaaatcgccatccagaatgcggtgtttacgagaaaagcgacagaacgtgtcatgcgctttgccttcgaattggcgaaaaaacggcgcagccatgtgacaagcgccacaaagtctaacggaatttatcacgcgatgccgttttgggatgaagtctttcagcagacagccgctgactatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagctgatgctcgaccacttcggagaggaagaattgggggcgaaaattctggatgtaatggagcaagtgactgccgacggcatcaaaacacgcgacattgggggacaaagcacaacggctgaggtcactgatgaaatctgttcgcgcttaagaaagctctgatgaatcaggccggggcagatggctgccccggcctgtccatttccttacgaaaatttccacgaaagtctaaccaagcagttccaaatgctgtataataatttggaattcttaggaaagcatcgggtgaaggaagttgaatgcaaaaacaatcacgttaaagaaaaaaataaaaatcaaaacgatcgttgtactcagtattattatgatcacagctctcatttttacgatcagattggtgttttacaagccttttcttattgaaggatcatcaatggccccaacgcttaaagactcagaaagaattctggttgataaagcagtcaaatggactggcgggtttcacagaggcgacatcatagtcattcatgacaaaaagagcggccgctcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacaggtgacttcgaagttgaggttccttccggtaaatattttgtgatgggagataaccgtctcaattcactggatagcagaaacggaatgggcatgccttctgaagacgatatcatcggtactgaatctctcgtcttttatccattcggtgagatgagacaggcaaaataaaacgcaatgcaacaaagaacatggaacgtacggaaccaaaacacgcgataataaagcactgtaagcgtttaaaaaatttctgatgaaacggggcggagccgtttttccgccccgttttttatgatagaaagcgttttgaagaaaagggccctgttgaaataaacagaatcaggattggcgaagccgtgaagcgcatcgaattggtaaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgtctgatcacattctggatgatggtttctcccgttttcagccgttcgtgttttgtaaattgttcgtatgccgtttttttttcttgcagtgtgtagacttcatcctcgccgagcaggttgggcgtcaacacatcatatccagccattttgatcagccggcccatctttttcatatggctgtttacaccgtatatttcgtgtacgagaatgacaagcggttttggggacataacggcctccttttgtgttttttccattatatcctatcgtttcactttaggctgagatataatggtcaaaaaaaggagatataaaatgaactcattatctttgcctcaccgctatccatttttgtttattgatggcgtgacggatagcgagcccggcaaacatgcggcagcttataagctgattagtgagaacgactggtttatcactgatacgcaaacagaaatgccgttttcacttgtgattgaagcgcttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcatcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctcggggttttcatttggtttgttttgctgttttctttctgtcatgtttgatcacctcaccgtttgttttcctcttatccgttctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgatgagcagctgatctcggatgaaaaccgcaaagccattcgtgaagcggaggataaaggtgtgtatgtggtgatcagcacgggccggacgctgatgacgtgccgggagctggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacataacggatcatgaatggctcaaattcggctttgacattgaggatgacgatatccgaaacgaagtgcttgaggagctgagaaaaaacaaagagctcgaaatcacaaattcaagtccgacaaacattgaagtcaacgcgcttggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaaagagagtcctaagatggactctcttttttagtttggcaggttttattctgggaccatggtaggttttctgacaaaagtatttcacaaactgatatgattcacttataatgaaataaagttcaaaaattcggaatagtcgttccgaatttcgggacaataaatgacataaagcatatcgtttgctttggcaggagggattctgtgtttcagattgatttaaactgtgatttaggagaaagcttcggagcctacaagataggccttgaccaagatattttagagtatgtgacatcagcgaatatcgcatgcggatttcatgcaggagatcctagtgttatgcgaaaaaccgtcgcgcttgcagcagaaagaggcgtgaaaatgggtgcgcatccgggcttgccggatttactcggttttgggcgccgcaatatggcgatttctcctgaggaagcgtatgatcttgtcgtttatcaaattggcgcgctctctggctttctaaaagcagagggacttcacatgcagcacgtcaagccgcatggcgctttatacaatatggcggcagtcgatcaaaaactgtcggatgctatcgcgaaagctgtctataaggttgatcccggcctgattcttttcggtcttgctgagagcgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctggaattgaagtgacagctatttcagaacagaggtcaacataaaggaggaacaatagatggagcagcagaaaaagacagcaggaaaaaaagcgggcagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactggggtatttcatcgccattctcgtcgtgcttggcggactagcttttaatattgggaatatcggaggggccgggctggggcttcaggtgctgttcggcattacacctgaaacaggcgctttaatcagtgccgttattgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacatcgatgaaagcaacccggcggcttctgttttcaagctggctgctggaaatgtcggttataaaattttcggattgatcatgtggtctgcggcgattacgtctgttattggagcagcctatacatctgtttcattttttaaaaccttttctccaaaaattgaaaagaattcacgcggtattattatcggatttattgtggtttctacgttagcttttgtcacaatcggccagcctgcgaagatcctcgtccttgtcggttcactgaacggcttaattctgccgattgcgctcggaacgctgcttgttgccgcctacaagaaaaacattgtcggtgattataagcatccgctttggctgacaagcacaggcgcgcttgtagtgattgtaatggcagttatgggaatctacacgttatgtacacaacttcctcaattgtggagctgatataagtggagcaattaaacaaaatggcgccaaaggatgtacgcgccctgatacgagaggggaaaataaacgggccgaccgcaggcatgtccggcggctacgcccaagcgaatcttgtggttttgaaaaaggaccttgcgtttgattttctgctgttttgccagcgaaatcaaaagccctgccccgtgctggatgtgactgaagcaggttcgcctgtgccgtctctggctgcgcctgatgctgatatcagaacggactttccgaaataccgtatttacaggcacggtatcttaacggaagaagtatctgatattacgccatactgggaggacgattttgtcggctttctgatcggatgcagtttctcctttgaacaggcactgatcaataatgggatagctgtccggcatattgatgaggggacaaacgtctcaatgtataaaacgaatatcgattgtgttccggcgggggcgtttcacggacagatggttgtcagcatgaggccggttcctgagcggctggctgtacgtgccgcacaagtgacttcgcgttttccggctgtgcacggagggccgatccatattggcaatccgggagcaatcgggattcgcgatctcgggaaaccggatttcggagatgccgtttccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtagcctctcgtcatcctgatgaacgagaattaaaagaggtgagaaagatgactgtacgatatcaaatcgaacagctcggtgattctgcaatgatgatccgattcggagaagaaatcaatgaacaggtcaacggcattgtccatgcagcggccgcttatatagaagaacagccatttccgggattcattgaatgtattccggcttttacaagtctaaccgtattttatgatatgtatgaagtgtacaagcatttgcctcaaggcataagctcaccttttgagaaggtcaagcgcgatgtcgaagagcggctggtagaaatagccgaagactatgaggtcaaccgccgcattgtagaaattcccgtctgctatggcggtgaattcggtccggatttagaagaggtggcgaaggtcaatcagctgtcaccggaggaagtaatcgacattcatacaaacggtgaatatgtggtatatatgcttggcttcgcgcccggttttccttttctaggcgggatgtcaaaacgcattgcagctccgagaaaatcatcaccaagaccgtcgattcccgcaggttcggtcggtattgcgggattgcagacaggcgtttatccgatttcaacgccgggcggctggcagctgatcggcaaaacgccgctggctcttttccggccgcaggaaaacccgccgacattgctgcgggcgggagatactgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggacacggtttcactgcgcattgccaatctgttgataggaaacggcgaaaatgaagcaggtctcgaaataacgatgatggggcccggtccgtcgtttcatttttcaaaacagacactgattgctgtgacaggggcggacttcacgctgcttattaatgacgaggaagcgcctttatggaagcctgtgctcatcaaggaaaacagcacggtcagctttggcccctgcaaactcggcagccgtgcttatttggcggcagccggcggcatcgaggtgcctgccgtcatggaaagtaaaagcacatacgtcagagcaggcatcggcggacttcatggcagagcgcttcaaaaagaagatgaactgaacattggagagatgtcagctctttcgcaaaccatcctttcccgcttaagttcgcagcttggaaaacagggatttgcagcaccgaagtggtcagtcagccgcggcagatttctgccattgaagaagaatcccgtcattcgggtgctggaaggaaagcaatttgcctttttcacagaagaatcaaaaacgcgtttttatcaagaagcatttcgtgtcacgccgcagtctgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcagacgactggcggctatccgaggatcgcgcatatcatatccgctgatcttccgattgtttcccaaatcatgccgggtgagcacgtccagtttgagcctgtatcccttcaggaagcagaagcgcttgcgattgaacgggaacagcatataaaagaactgaaaacgagaataaagatggaatggctgacatagcaaaggggatgcatgatgcagaataaaaacaaaaccgtagtcaaatctatggcgctgctcaatttgtttttgcataaaccaagcctaaccttaagtgaactggtgtcgctgacgggaatgccgaagacctctgttcaccggatggtcagctctttggaggaaatggggttcctcagtcgggatgcgtccggcgcttattcgctgggattggtgtttttggaattcggacagcttgtcgctgacagactggatatcagaaaaatagcgaaaccggtgatggaagagctgtgccgggaagtggatgaagccgtgcagttgatcatgagggacggcaatgaagcgatatacgttgagaaaatagaagggacacagactgtgcggctgtatacggcgattggcaggcgttccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccataagcgccaggtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatgatgcttcgatatacagctctgggcgattccttgacgacagggagaggctcggggctgttttcacccggcttcgtccagcgttttggggacatgatggaagctgacttgaaaacaagaacggcaataaacatatttgccagatcaggcctgaatacagaagagattttgggactcctgtcatatccctatgtgcaaaaatgcattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaaatcgccgagatcaaaggagaaaatccttccccgtacgccatccgagtgttcaacttatacaatccgtttcccggcattgaaatcgccggcaaatggatcacatcctttaattcacatttagaaacacttgcatcagcaccccatgtcaaaatcgcagatgcctatagcatcttcaaaggcaaggagcgggaatatctgtcctttgacggtgtccatccgaactgcaaaggctatcaagcgatggctgaagccgttcacaagctaggctataaagaattatcagtttcatagaaaacgcgcctcatgacaggcgcgttttgtatgtgtgatcgaaatattaaaagaaacttaaaattccctttcttctgttctacagacaaacaaagtgcgctagaataatggaggacgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcagggacttgaagagcgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctccatgcattttgataacgagtgagtgatatagcccttcatgccggaaataatcggcgccgcttgccggaatgcatcctcaaactcttgttcaaggccttctttaatgtgaagcattgctgcctctctgaccatgctatcccttctttctgtcttttcaaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcgataaaaaagagaaagttataaaagaactcgccaaaaaacttgatttgactgaagacgacatcaagaaaaagctggatcaaggctgggtaaaagacgattcgtttgtgccgctcaaaaaggtcaagcctgaccaggagaagttagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaagacaagctaagaggcacaactggctggaaaatctacgtgccgcaaaccggggaagtcatcgctgaaaagaaagcaaaggacggcgaggatcttcacctcacaattgatatcaaaacgcaaacgaagctgtatgatgaactgaagaatgacagcggggcggcagtcgccctgcagccgaagacaggcgaaacactcgcccttgtcagcgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtttctgagagacttcaacaagtcgatttggaaaacgcccttattacgtcagacaatatttattttgcccagaatgcgcttgatatgggagcggacaccttcacaaaaggcttgaagacattcggtttttcagaggacattccgtatgaattcccgatccagaaatcgtctattgcaaatgacaagcttgattcagacattttgcttgcggatacaggctatggacaagggcaaatgcaaatgtcttcgcttcacttggcaactgcttacacgccatttgttgacaatggagaccttgtcaaaccgacgctgatcaaaaaagattcacaaacagctgatgtttggcacaagcaagtggtcaccaaggaaggagcggcagacattacaaaaggtctgaaaggcgttgtggaagatgagcgcggatcagcgtatcagcctgtcgtgaaaggaatcacagtggccgggaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggtagccactatgtcgttgagaaagcgaaaaagcaatttcaatcgaattaaaatgtctttttaaaaggagcgaaaggaaaaaggggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctaagcctcattgaatggtgtatcgatcacggcatcacgacctttgatcatgcggatatttatggaggctatacgtgcgaaaagctgtttggaaacgcccttgccctttcgcctggattaagagaaaacatagagctggtcacaaaatgcggtatcgttcttgaatcgcctgaacggcccgctcacagatcgcatcattataacacaagcaaatcgcatattttggcatccgttgagcaatcgcttatgaacttaaggacggattatattgatgtgctgttgattcacagaccggacccgctcatggatccggagggggtagcagaggcgtttcaggccttgaaatgctctggcaaggtcaggtactttggcgtttcaaattttaaagatcaccagtatcggatgctggaatcgtatttgcctgagaagcttgtgaccaaccagattgagctttccgcatacgaattagaaaatatgctcgacggcactttgaacctgtgccaggaaaaacggattccgccgatggcttggtcgcctctggcaggcggcaaagtattcactgaaaacacggataaagaccgacgtgtccgcacggcgcttgaatccgtccaaggggaaatcggcgccgcttcattggacgaggtcatgtacgcatggctgtatacgcatccggccggcatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcatagtgccaaattaccatttataagtgattgattcttgcttgaaagcgttttatattaaaaggaaacctctctatatcctctactgcatctccttgcgacttcatccgcacatcaagatagtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaagataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttctcccttcggactgacactgatccgcaaaagaggttttggcatccagcttatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgttaaaaatggagcgcatcttatttcagctcaaagaaaaaatcgctttttcattgtccgacagctcctatatagcgctcgtcgtccatctgacgtatgcgatcgaacgaattaagcttggggaaactatcaccatggagcaaaatgagcttgaggaactgaagaatgcgaaggaatacagctccgctcttgaaatcgcgggtgagcttgaacgtgccttcggcgtgacgattccagaggcggaggtcggctatattacaatccaccttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggcgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccactattaaatgaggaagacgcaaaccaggtcaagcagtatatcaagcggaagattccccttattcttaacaaaaaaagaagcccgaaggaagaagcgcagcaagctgatgtacctgacatgctagaggcggcggaaagcatagggcggtatatggaagttatccaagatgttctgcgccattttacgctagctcaactcaaaacaaacccggaccatagcatgcttttgctagagctttttcaacagctgaagaaggatggcctgatccgtaatccggaaaaagccgcggtttgcctggctgagcgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcatcctcgtcatgatggcgcctaactcattatctgctgaaggctcggagattttaagcgcgatcagctcggcaattatcgagagcggagaaagcatggcggggtttcaggaagaaggagaacaagaattgtatcagcggttaaaccgcatatttttcacatggatgaaagaaaaaaacatactgtaatcctgcatggcacacgtcaaaaatttggcgtgtgtttttctttggacggggaacaaaataagaaaatgtgggactattttatcattcagtattggaataattccaaaatgaaatagttttacaagttatcttttttgggttaaaatgggtgaggtaaggaagaaaatctaacaaattattgaagattcaagagaatataggagatgacgatatggaaacattacagcatctgattctgcatgacatgccgaatagcgaagatatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcctcaacagttatgttcgccgcacttgaaataggtgctgttgtcgtacctgtcagctggcagctgaaaccatatgaaatgacaggcattttaaaagcaagtgaaccgaaagcaatgttttacggagcggagtttaaagagacactagatgaagttcttcctgaattgtcctcactgtgtgtaacaatggaaacaggaacagcttacgaaacatctgctgaatttgaagcgctgtttgcaggtcctgatcatttgccagagacggaaatggtttcccctgatgatacagcacttctgatgtttacatctggaacaacgggtaacccgaaaagatgcatgattacacatggcggcatatacagatacgttaaaaaatccaacagctcaatagcacgcatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttctacacgtatttgcttgaggcgtgggaaacgcaccaaactgacttatcttcgcttgttattttaatgacaggcggaacaaaagtgccgagcagcctaatccgccgctatcttgatattggcattccgcttgcgcatggctatggaagtactgaggcttggggcatcagcacatggacgcctgatatgggaatggataaagcggcatctgcaggaaaacctgtggcaggtgttaaagtcaaagtggaagatcctctgactggagaagaacttcctcaaggacaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacggaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcagttgcacagacggaaagctcaggcttaatgttcttaaattctatatcaatgtcttcgaagccggctgctttaaagtcagcattcatctctcttccaaatgatttggttttctcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttaatttcctcccagcgttccatgtgaaacatttttctgataaagcaatgcgaaggtgccaagccatgtttatccatagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgagaagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaacgggcagcgccatcatcaatacgacatccatcaacccgtacgtagggaacccgacactgattgattatacagcgacaaaaggggcgatcaacgcctttacaagaacaatggcgcaggcgcttgttaaagacggcatccgtgtaaatgcagtcgcgccgggtccaatctggacgccactaatcccagctacgttccctgaagaaacagttgctcaatttgggcaagatacgccgatgggccgtcctggacagcctgttgagcacgtcggctgttatgtgctcctggcatcagatgagtcctcttacatgacaggacagaccctgcatgttaacggcggaaactttgtgacgacataagagggagtgagacatatgggcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgctgccgctacggaaaagtgtatctttacgtagaaggagaaaaaacgccgcttccaaaagttctccctcctcaggaagacagagaacactatacggtctggcacgaaattgagctagaaccgggcgggcaatatacaatcccaccgaatacaaagcattggttccaggccggggaagaaggtgccgtcgtgacggaaatgtcatcgacgagcacggataaacatgatatctttaccgatccaagaatataaggatgggcttaacagcccatcctttttgtattgaaaaaaacagaatcatcgctataatggttaaaaaaggaaagagggcgaggcaatgttcacttgcaaggtaaatgagcacatcaccatccgattattggagccgaaggatgcggagcggctggccgaactcattatccaaaatcagcagcggcttggcaagtggctgttttttgcggaaaatccaagcagcgctgaaacgtaccgagaaacaatcattccagattggcggcgccagtatgccgacctgaacggcattgaggcggggctcctttatgacggcagcctatgcggcatgatcagcctgcataaccttgatcaagtgaatcgtaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaatgaaaaaagcagagcggttccggagcggctcgggtttctagaggaaggcagtgcacgggacggcttatacgtaaacggcaggcatcacgacctcgtctactacagtctgttaaagcgtgaatgggaaggcgaaaaataaagagcacactttcttgtttaaatcttccccggatgtggaaaagtaacagcggagacgttaaaaaggagtgattcgagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcggaagaaattgagaacaaccccaatgtccacattttattaggctatgattgtgaaggttttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattaatgaatgccggggagaaaacaccggtctcactcgaactataaaaaatttgtgttttcaagggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttcattccagtcttatctctaggatgaaattggaggaagaataacgtgcatgtcattacaacacaagtactttttattttttgttttttattgctgattcactcgatagaaactttagcctatgccacaaggctttccggggcccgcgttggatttattgcgtccgcgctttctctgtttaatgtcatggtcatcgtatccagaatgtcgaacatggtgcagcagccctttaccgggcatttaattgatgatgctggaaaaaacgcactggcgattgtaggggagcagttccgctttttaattttcggatcgacagtcggcaccattttgggcattatcctgctcccgtcttttgtcgctcttttttcacgggcgattattcacttggcaggcggcggcggctccgtttttcaagtattccgaaagggattctcgaaacaaggattcaaaaatgccctttcctatttgcgtctgccgtctatttcatatgtaaaaggatttcatatgcgcttgattccgaagcgtttgtttgtcatcaacatgctgatcacatcgatttatacgattggcgtgctttcggctttatacgcaggccttctggcgccggagcgcagtacgacagccgtcatggcttcgggtttgatcaacggaattgcgaccatgctgctggccatttttgttgatcctaaagtatccgttctagctgatgatgtggcaaaaggaaaacgaagctatatctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagccttttttgcgttcccttatttatatttccttaatccgcggtcgtacaaaaaatttccgaatgggacgaaagcggcgacgaagccggcagctgaccatttcagcggccatttgacagagaaggttgcataagccaagacaagcaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccgatcggcgtttgcagcataaatcgccctccttgtggacacgttttcattttatactataaacaatctggggggcatatgacagctttcaaaaaatgttcagaaaacattcatttttacatgccttttctagggaactgtacttgtcatttacaaagatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgccaccatctgtaacagaacgggtaagacagcttgaatcgtttggcatcatcaagcaatacacgctggaggtcgaccagaaaaaactggggcttcccgtttcctgcattgtggaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgcgaagtctgttataataacaggatgagcgtgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccggaaggctacggaaaagaatttcaatcatggcgcctagaggatctgccgattatcccagaacccttgaagcttgtggtgataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcaaaagctgcgcagcggcaaagaatatgaaaacctgtaccattctgccgtcgccagagcggaagcggattggattgtggggatcaatgccacccgtgcacttaccacaaaattcaatgcccagctctcatgcgggcgtgtgcagactccgacgcttgccatgattgcaaagcgcgaggcagacattcaagcgtttacgcccgttccgtattacggcatccgtgctgcagtcgacggcatgacgctgacgtggcaggataagaaatcaaagcagacgagaacgttcaatcaagatgtaacaagccgtctgctaaaaaatctccaaggaaagcaagcggtcgtagctgagctgaaaaaaacagcgaaaaaaagctttgcgcctgcgctttatgatttaacggagctgcagcgtgacgcccacaagcgcttcggtttttctgctaaagaaacgctttctgtactgcagaagctatatgagcagcataagctcgtcacatatccgcggacggactctagatttttatccagtgacatcgtcccaacgttaaaagaccgtctggaaggcatggaagtaaaaccgtatgcccaatatgtcaaccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgacagagaccagacacttcctgcgcttcaaaaaggcgacacacttgccgtccgcacgttaacggaaacaagcggccaaacgaagccgcctgcccgctttaatgaagggaccttgctgtcagcgatggaaaacccaagcgcatttatgcaaggagaagaaaaaggcctcgtcaaaacgcttggagaaacaggcggcctcggcacggtggcaacgcgtgccgacattattgaaaaactgttcaacagctttttaatcgagaaaaaaggccaagatatttttatcacatctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacatcacgggaacggcatgtccggaatgcggcaaaatgatgctgaaagtaaacggcaaacgcgggacgatgctcgtgtgccaagatcgtgaatgtggaagcagaaaaacgattgcccgaaaaacaaacgcccgctgcccaaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggtttttttagtggacttaggtcctgttttcttaatgttcaaaaaggggaaaaaaagctagcaatctgcatttttttcttttatagtaaatgtactttgtaacatggcagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcgacagaagtgaatgccagcccgctccagccggcggaatatttcatctatcacaatttaatgaatgacaaagggctgatcaaaaccgatttttcagaccagccttcttacttgtcggaatctctcggcctgtggatggagtttctgctcagcaaaaatgacgcaccgcatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaatgggttatttacagactattacgactcacaggccgcttcaaaggatgtgacgctttcatacgtcatgcctgacgccttagctgtcttaaagaagaatggaatcatagacgaagacacagaacagcggaatgccaatgttctctattcagctcctttaaaaaatggctttctgccgaagacatacagctcggagacgaaggaatacacatatgatagtgaaatcaacctgattgatcagctttacgctgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgccttagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctttgtttatttattatgtgtcagcccagcaatcagaaggtgctctgatcctttgcatcacatttggcgtcatcgccgcaggcatctggttcggcccgatttacgcgctggcagtgaccttaatcgtactctttgttctcggcaccttaatgatgtttttccagactggacagacatcgctctttccggctgaggaagggctgcgaatgcttgttgtgtggggaatcgcgcttttgctgttttcttttatttctggaagaatccacgatattacagcagagcttcggcgctcaataacacggcttcaatccgaaattaaaagctatgttgctgttgacagagtgaccggatttgataacaagcaaaggatgaggctggagctttcagaagaaatcaagcgggcggagcgctatggcaattcttttgtttttttgctgctgcatatgcattatttcaaagagtttaagtctttgtacggtgaaaaagaaacggaccgcctcttccaatatgtcagtcagcaaatcaggacaagcgttcgggaaacggataagaaattccgtccctctgatgagcgtatcgggatcgtgctgacgcacacgcctgctgaacatatgccggcagttctgactaagctgaagaaacaattggatacatatcagctggaaaatggaaagtatgtgtcgcttacgttccacgtttgctatttgccctaccgcaacgatatcaaaacagctgatcaatttttagaagaactggaaaacgagatgatgatgaatgaactataaaggaatcacattgccatgcgtcatgatgcttctatttttagctattgcgtcttttcccgtttctgcgcaagcgaaagatcaagatgccggcattctcatcatctactcaaccttggacggcaaagagtcgtcacaagtcaaaatgctcgatttgcttgcgggccactttacatcccatgtgacagtcaaaaaagattcagacgttgaagcatcggatttcaaagggaaagaccatgtgatttatttcggccaaacgaaaagaaagctcagcaaaaaattgctgtctctgatcagcggcgtaaaaaaaccggttgtcgccattggctataacgcaggccaaatcagccaattttccgggctttcattagcccgcaaagaaaatgtgtttcaggttcacagcaggtcggaaaaggccgatgtgtctctggaaagcgggcttaacgtgctgagtgtatcaggcctgaaaggaacggcgctttacaccttcaaagccgatgacggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaattgctgcttcaagccggtacatacctgcataagcggcatattccttttatcctggcggtcattccggtttacttgaatccggaaacaggcgacaaagtgtatttgtctgatcaaccgaagatggtcaaggtgctgaagaagctgcaaagcatgggcggcagtatcattgttcacggctatactcacgcttatcgctacagtgaaacaggagagggctttgaattttgggatgcaaaggcggatcagccgattacatccggaaatgccgaagaccccccgtccattttggagaaagaacaggacttcccgaacgaacaagcctatcacagctatctcgaaccatttcgggaaaaggaagaaacgtatacaaaacaaaaactgacgcgtgccattgaggatttgacatcatcgggtctttacccgctggcgtttgaagcgccgcattacacgatgtccgattatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcaaagcaaaacccgatcggtgagatggaggagcacatctcccagatgattgattttgaaggcggagtagccggaggattttatcacccgtacctcgggatgaaatatctgccggagctggttgatcagatggaacgcattccagacagtgaatggcttgatttaaagaaaacgaaacaaaccgtcaaaacagacaaagtggaaattcatacaagcggtgacggaacgattcaggtgaaaaacggcgtaagcgccattgacgagtttttcgatcatcatcgccaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccgaagtggagagaaaatatgaaggaactgccgaaggtcagcgtcctcatcccggcgcataacgaagaggttgtgattcggcagacgctgaaggccatggtcaacctttattatccgaaggaccggctggagattatcgtcgttaatgataattcatcagaccggacgggtgatatcgtcaatgaattttccgagaaatacgatttcatcaaaatggtgattacgaagccgccaaatgcaggaaaaggaaaatcctctgcacttaactcgggttttgccgaatcgaacggcgatgtgatctgtgtgtatgacgccgacaacacgcctgagaaaatggctgtgtattaccttgtgctcggcctgatgaatgacgaaaaggcaggcgccgtggtagggaaattccgcgtcatcaatgcggcaaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggctgggatgacaaagcgctcgctgaggatactgagctgaccatccgggtatataatctcggctatcacatccgctttttccctgccgccatcacgtgggagcaggaaccggaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtacttcctgtttttctttggcgtgatcatgtcaaatgcgatttttgtagtgaatttgttttatgatttgcatttgtctgttggatttttggcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttattcgtagaaatcaagcaccgtctattcaagcaagaggtcaaatggtacaagacagaacgatacaatcaacataaaagcgggtgacctttttgaaacaaataatcatttttctcacaagcttcatgctgctggcgatgactggacaaacggctcttgccaaagacctacaggtcagcggttcgctcctcgggaaaagcagccaagaacaagccaaacagcaggtgctgacaagcgagctgattacactgtatggatcaaaagacagcgcagagctgacgtatcagatcccggcaggcgcctcttcgggcaatcagcaattggtaatcgaatacgaggcatcaaatcttttaatttctccatcatcgttaacggctgtcattgatgatgaaccggtcaagacgttaaagcttgatggtgattccaaacggaaaacagtgaagctgaatctgaataaaagccagtctgcgcaaggctatcacaacgtatcgctgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagctatcgtcattccggataacccaagttcagcagaaatagaagctgctgttaaaacagaaggctatttgaaaacggtggacagcagtatcagtattgcgtatgtcacggaatctgaactgaaaaaaatcgataagccgacgattgttatcggcgtggacaagcattggaacggcaaagtgaaaaaactgttgaaacaagccgggctacaggcaaaaggagaaaaccttctgcttgcggagcgggtgctgaaagcagagggcaaacagcagccggttctgtttgcgcaagcggcgtccgaggacgcgctcactaaaaaaatcagcgtgatgacagatcagacatatacaggccagctcagcggcgatacactttcaatcagcaagcttcagcagactgaaaaaaaagaaagcgataagctgacccttgagaattttggagcgggtgatatcacaattggagccgacaaaacatcttcagcacattatttttatccggcttcggctgttttagatgaaaaccaatcggcgaagctgtcgcttaaactgaaaaagtctgaaacgattcaggcctcaacggctgaaaacgagtcagcctctcaggctgcagaactgaaagtgatgatcaacggccagccgcactcggtccggcttgatgaattaggaaaagaagataaaaacggattctatcatgtcaaagtgaaagtggaccctaagctgctgcaaaaaaaccgctacattgatattcagttcgtcacgaccggtttaaaggaaaacaacccttgtaacaccactgatgaagaaaagtgggtttttatcgataaaaacagtacattatcatacgccatcaaaggcatgtccccgtcagcggattttcaagagtggccgctgccttacgccggaaaccaggatcaaacaacgttaatcgtgcttcctgacaccgtaagccaatcgaagctagaggagctttctctcgtaacagaatcctttggcagcgaagcacagcattcatatacggtaaagaaatcatctgacgttacagcaaaggatgcgaaaggacgaaacctcattttcataggggggatcaatcaattttctcttctgaaggagaaatcatcagatctgcttgtgccgcaggaaaagaacggctcgtttgatgtatctagtttcgagatgctaaatgagacgacaaaacaagtggtatttacccaagcatcggtttgggattcacgctatacaatggctgtctttgcaccgtcaaaaggagatggcgcggctgtcacaaaagagatcatcagttatctgaacagcaacgatgagtcggcaaccgtccttaatgaaacaaatagccagcaggtgtttacaaaccaccagcagctcaaatcggaaacaaacagttccgatgcagaacaaccaacacaggatcatagccagaaatggatgtatattggtgtgctggcactcattatggtgattgcggcagtgttcatttggattgccgtaagacgcagaaaaagaaagacagatacagaataaaacagaggcgattttagcctctgttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcatcaacatgtgagagcaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgtcgcatatgggacagaacaaattctaatcattttggcaacaatcagtgcagccgcattttggtactccattccgattgcggttggcgttctcatcttgctgctcgcactgattctttcatacaggcaaattatttacgcttatccgcagggcggcggggcgtatatcgtttctaaagaaaatctcggtgaaaaaccgggattgattgcgggcggttcattgcttgttgattatattttaacagtagcggtaagtatttccgcaggcacggatgccatcacgtcagcctttcctgcattgcatgattatcatgtgccgatcgctatttttctcgtgttagtgattatgattttgaacctgcgcgggctatcggaatcggcatcgattcttgcctatccggtttacctgtttgtggtggcgcttttggttctcattgcagtcgggttgtttaaactcatgacggggcaaattgaccagccagcccatcatacaccgctcggcacacctgtagccggcattacgctgtttttgctgcttaaggctttttcctccggatgctcagcgttgaccggggttgaggccatttctaatgcgattcctgcattcaaaaacccgcctgcgcgaaacgcggcaagaacgcttgcgatgatggggattttgctggcgattctgttttccggcatcacggttctcgcgtacgggtatggtacggcgccgaaacctgatgaaacagtggtttcacaaattgcgtccgaaacctttgggcggaatgtgttctactatgtcatccaaggtgtcacatcgcttattttggtccttgcggcaaatacgggattttcagccttcccgcagcttgccttcaacctggcgagagaccagtatatgccgcgaatgtttactgtcaggggcgaccgcttaggcttctcaaatgggattatctttttaggctttgcctccattgttctcattatcttattcggaggacagacggagcacttaatcccgttatatgctgtgggcgtatttattccatttacgctttcacaaaccggcatgtgcatgaaatggatcaagcaaaaaccaaaaggctggatcggaaaaatgctgatcaactcctgcggcgctctgatatcgtttatggttctatccattctgtttgtgacgaagtttaatgtcgtatggcctgtgttaatctttatgcctatcgtcgttttgctgttttttgcgattaaaaatcactatacagcggttggtgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggagtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggccttcctcctcagagtccggctgttctggaaaaaggacataatggttgccacactgccgtatcattttaaaaagtaaagctctaggaccaagggaatcaccttggtccttttttgttggaaaaggaggtatggcggtgtatacacaaggtgcttttgtgatcgtattgaacgaaagtcagcaaattctgctgatgaaacgaaaagatgtccctctatgggatttgccgggcggcagggttgatcccggggaatcggcagtgcgggaggtattggaagaaacgggatacaatgtagcgctttctgcgaaaataggtgtttaccaaaggccaaagtttcaagatgaacagcatgtgtttttcggaagcataacaggcggacaagcagtggctgacggcacagagacagcgggattaaagtaggtttccccggagcgtttgccgctttttatggtgccgaaccgaaaaaggcagatcaatgatttcaagaatggcgctcaagatgtaaatgtcaccgtcaaggatagaggattgctcgcggcgatcgacctgttgaaaagaagactgggcaagcgataaaggtctccgggttttaaagcctttctcctgtggtattgaaaaaaggaaaaaggaggatacgttatggcacacaaaactgcaggacaagcaatgacagagctgcttgagcaatggggagttgatcacgtatacggcatccccggagacagtataaatgagtttattgaagaattaagacacgaaagaaatcaactgaagttcattcaaactcgccatgaagaggtagcggcactggcagccgcgtctgaagcaaaactcaccggcaagatcggagtctgtctgtcaatcgcagggccgggagcggtgcacttattaaatggtttatatgatgctaaagccgacggcgcccctgtgctggcgattgcaggacaggtttcttctggcgaagtcggacgggactatttccaggagatcaagctggagcaaatgtttgaggacgtggccgtgttcaacagagaggtacatagcgcggaatcacttccggatctcttaaatcaggcgatcaggaccgcctacagcaaaaaaggcgttgcggtattgagcgtgtcagatgatttgtttgcggagaaaatcaaacgggagcccgtgtatacttcaccagtgtatattgaagggaaccttgaaccgaaaaaagaacagctcgtcacctgcgcccaatatattaataacgctaagaagccgattatcctggcagggcagggaatgaaaaaggcgaaacgggagctcttagaatttgcggacaaagccgccgctccgatcgttgttacactcccggcaaagggtgttgttcccgataagcacccgcattttctcggcaacctcgggcaaatcggaacaaagccggcttacgaggcaatggaggaatgtgatttattaatcatgctcggaacgtcattcccataccgtgattatttgcctgatgacacgccggcgatacagctcgattcagacccggcgaaaatcggaaaacggtatccggtgacagcgggccttgtctgcgattcggctctcggcctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcacgtcttcaggaagcggcagccgatgatgcggtgctctctgtagatgtcggcactgtgacagtctggatggcgcgtcatttcaaaatgaacgcgaaccaggatttcatcgtttccagctggcttgcgacaatgggctgcggcctgccgggagcgattgcagcaagcttgtccgaaccggaacgccaggcgatcgccgtctgcggtgacgggggattttccatggtcatgcaggaccttccgaccgccgtcaaatataagctcccgatcacagtcgtcattttaaacaacgaaaatctcggcatgattgagtacgagcagcaggtcaaaggcaatatcgactatgtcacaaaacttcaaaatgtcgactatgccgcatttgcagaaagctgcggagcaaagggcatcaaagtgaccaaagcggaagagcttgcgccggctttccatgaggcgctgcactctgaccaaccggtcgtagtggatgtcatgattggaaacgaaccgccgcttcctggcaaaatcacctacgggcaggcgaaaggctttagcaagtacatgctgaaaaacttcttcgaaaaccaaaaatttgaaatgccgtcactgaagaaaagtttgaaacggttattttagtgaatataactaagggttattgggataactcccaataacccttttaattaaattgaaaaacctatttttagatttagatgtcgactcataggatcatagatgtattgtaagaaagtgtttacatataaaaaaatgatatgttattatgtccttgtatttccatttttttaaaaaggaggaactataaggctaagtgtttcggtcgataaaaataagtataaggggaattagattatgaaaaaaaagttatttagtacaatttcaataggggtattaggagtaacattttttgcgaattcttatacaacgcaagctgcaccagagcatattaaacaggtaaaacatattgaattaaatactggtgaagatgaatacacaacaaaaaatgcatttgctgctggagttgctgccggtattgttagtgcagcagtttatgatggcattaaagccgctggaaattggttgggaaaacaagcaaacaaagctaatgcacaatctatatatagtgcagctcctgctagaaaatatgcatgttatatagtgaatcctcaagatcacaaggatattgatatttcagaagttgcggaatttggtaggtaaaaaggaaggggcctcccttccttttcaaatggaggttgtataatttgaagacaaagaggaaatataatttacttgttttgttcctttctttattagtagtattccatacaataataatgataatgtataacttgccgttaaatcctgttaactttaagcatgagaaattaatttcaacgtatatgaatccattatttactcaaaactggcaattatttgccccagatccggtaagcacaaataacaatattatctgcaggggggtctttacaaataataaaggacaaaaagaatatactgagtggatagatattacagaaagttataatgcagatattaaaaacaatttattttcaccaaacagattaatgaaaactgcgctttctggtgctgtctttgaggttcaaccgtatctaaagctgaatgataaaaagaagaataaacaattaattgagaacgaatacatccgaattatatctagtatagctgtgaaaaaaatagagagaagtaagaaagtaaaattagaatcattagatgttaagttgtctatagaatcgtttcctgagtatggaaagaaggggaagtcaaaatttaatgtacagcagttcccccatatcaatttactaacaaaggaatgagatttaatttgaaaattattttaaataagttcagaaattttaatcatttaatgtcaaataaaatgcattatttaataggttcaagcatcttaaggatatttattggattacatattatgtttacttatttaattcactttgctcaaaggaatgaaatatggggacctaatgctttttattcatttgaaaaatgctttgaagcttatggttttacttctctatatctttttagtgactcacagttatattttgagtttatttttataagtggaatagtcattaatactctgtatatattagggtataaaatgagaatagtcagcatcataaattttatttgggtttggtctttatatcaaaggaatccttatatacatgacggtggtaataatattcttattcttattatgttgtatcttatttttgcatccttaggtgagttttttactattcatactgaatcccgttcgaaagaaaagtctaaagttactattattattcacaatttctcagtgatgatttcaatgattcaagtgtctttactttatttttttgcgggctttaacaaagcgcaaggaaaaatgtggacccatgggaccgcactttactatatactacaggttgatgaatatagtataaacaaagggtttacaaatctcgttattgataacccttatcttctagtattaggaacatactcagcattgtttctccagctaatgtttccaatattagtttggaataggtattttaaaattcccctgcttataggttcaattctttttcatttatctataattatatttatgggtcttcttcaatttggtgttataatgatagcccttgatttattgtttataacggatacggagtataggaaattgtacaagtttttatcacgaatttatgataagtttaaactgaagtttaggaatattttcaaccaaaagttaagaaatcccaccatttaaaatatcgtttaaatgttaatgtcagactgttataatcattatgtcttttcaatccaatttagggggaaggggttttatgtttgattacattaagattattatttatttaatcggatcaattggaatgatctacgcttgttatcacgattataactatgcaaaaaaaggacaaaatgacaagtgcatatttttcaaaaataaacgattaagtggagtagtgctattttgttatttgtttttatttttagctaatcttaaggacttcttgtttttgttaattaacacgaaataaatacaattgtatagttaaaagactgtcgatgtgagtcggcagtcttaattttacctagtcaattattttcgtccttgtatgtttattcttatcaaatcttacagacttcttctcataatagggttatttttcttttttcttcagcccgaagaaaaaaggaaaagcagaaccgaccaagaaggtgccgaataaaaacatgccgccgataaacacgtggaaatttgtgtgtccggccgtaaacgccgtgattagggaaatgatactgagcacgatcatggcaatgccgggcgcgactctcatttttcccttggatttatgggcagcaacagaacataaaatgccgataacaataggaacaatccacaaataaaacagaataaatactgacatcatcaaaactccgatttttcttctatcataacaaatttctgtcaaaaagggtatcaatgagcttttgtgaaaaaataaaaaccggctttagaagccggtttttttatcgaaacgtatctacaattaaaaacacattcaaagcaacgatcaatacagcaatcagccaagacaccactgtgatccatttggcgttgatcagagatcccatgatccgtttattgcttgtaaacataataagcggaatgagggcaaaggcgatcccgaaggacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcgagatcctcaacaaacaggccgtttttgaagaataatgcggcagccacaatcagcatacttgcattaatagcccctgcaatcagcatcgctattaaaatatcaataaattcaaatctaaagatttttttccgttctgcatcagttttgccaaccacccgccgctgtgtaagggcagagtgtaaataaatggcgtgcggcataacagttgcgccaagaatacccgctgcaagaagcacactgtcagtgccatgaaacgccgggacaaaaaggcccttcatcactgacacggcatcaggctttgcgaaaaaggtctgcagcgcaaaggcgatcacgaccacaaacagcataccagcaataccggcttcaagtgagcgataaccgcggcgctgaagctccaatatcgcgaaagaaccgatcgcagctataatagacgcttcaagcatcggaatgccgaacagcaaatacagtcccagagccgctccgataaattccgccagatcagttgcgataatgaccagctcgccctgaatccataatccgatcgagacaggcttcgggaattcttcacgggcaacctcaggcagatttttgcctgtcgcaataccgagtttggcggatagggattgaattaaaagggccatgatattagaaaataagatcacccataagagcatatatccgtatttagaacccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacacttctgaatttttccctgttatgtaacatgatatgtagggattcgggataaggtcccatataaaaagacatcgtttcagttcgaaacgatgccttctgtatctaatgagtctaggcttccttccgcagcccgcggaatataaggcccagcaagaatacgaagatggctgccccgatgatggccgggaaaatagcaaagccggcgaggctcggtccccatgtgccaagaagtccgtgcccaatccaagcgccgatcagcccggcaatcatagagccgaaaattcctcccggcagccggtttcctacaatggcgctcccaattaatccgataacaatagcaacaactaatgaaaccaaaaagctaagcatcatgatcacctctcataaatgatttaccaatcaataaccgctcctgatcatttcgaaacacctaaaagcatattcctttatgatcctgttttaatctttctctgcacactgccgtcagctaaatgaacaatgacctcagtgcctttatgcgccgcgatttcctttgcatccttgatttcagacacgcgtttggcgccctcggctttgactgcccagccttttttatgcttaataacatgttctgctttgttcatgagctcggagccgctgccgctgcttggatcagcatcgcgttctgtctcatcatcatgcgtcaggaaatcatcaatttcatctgtagaggcgttttccgcccattccttcgctttgcttgtcgcaattggaatcgcgcgcccttcctcatagccttcatcaatcatcgcattcgcaatgtctatcgccttttttctcaccggcttctcaagattttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcggattgggtgccaacagaacgaaaagaagacttacatcagcaattaaaagagatagagaaatgggaaaaagatcagcaaaaagtctggttttgggaaaagctcagccgtctcccgtttcagctgctggacaagctgacaccggaattcatccagaaaaagatcggcaagctcttggatgaggtcggcagctttgttcaaacaggcggacagtacctgacatctgaaaaacagattatcaggatgtttcaaaagaaactgccggaggagatctttgaatcgctggaggacgtccggaaagcgcctcttcctgtcatggatgaaattgcggaaggaatgggcaaaaacagaaccaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgcgtcttcattgtgaaatgcctgcagctgacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagtagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacaataacaaaatgagcagagaagaagcaggtagaaaaggcggagaaacaacaagcaagaaccatgacaaagaattctatcaagagattggtcaaaaaggcggagaagccaccagcaaaaaccatgacaaagaattctatcaggaaatcggcgaaaaaggcggagaagccactagcaagaaccatgacaaagagttctatcaagaaatcggtgaaaaaggcggagaagtcactagcgaaaatcatgataaagaattctattaagaaatcggccgaaaaggcggagaggcaacaagcaaaaatcatgataaagaattctaccaagaaattggctcaaaaggcggaaacgcccgcaacaacgactaatcaaaagcataaaggcagacaacctgtaaataaaaaagcgatccggcacatcagctggatcgcttttttttggaatcttctcaatttatgccactattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttacgtcagaacggtaaatctctgtgtggagcataaacaagccaaaaccgtcatcatagaggagcagccatgctaatcaaaaagatgatatgtgaagtagacgctgcaaacgctgaagcatttgcaaaagcgcagtcacagtggggagcattatcgcatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgttcacgatctgttacataaccccgatatccggtacgaaccaaactggacggttctgaaggcataatcaaagcccaaaacatcatgttttgggcttgtctctttactcgcgtcccggaagtgtattatgaacataaggcggtgctggttttaactccggtttttctccaaacgtttttgcctctttcacatattcaaaggcttctccgtccggcgctttttcatttagccagttttgcttggcgctttcttcgccttcagagaaattgataagctgatgtgagaactcttgtttttcgagcgctttcgggaaggtacccggcacaaccggaccttcctgtgcttctaattctttaatggcggcaagccattgattctggtgcattgtgtcacgcgccagcaggaagctgagcatatctttgacgcctttgtcatccgtcatttcaaacaggcgtgcgacctgcagacggccctgtgattctgcattcaggttggcgcggaagtctgccagcaggtttccgcttgctacgatataaccgccgctccaaggtacgcctgtactgctttccggcatggcgccaagtcctgatacaatcgcatggtgagggttcatgccgcccaggatggagccgatgaccggatcttcagcagctttttcctgctgatcaagaggggcatcctcaagaagtctggcaatcatcgttgcgatcatttcaacatgcccgagctcctcagttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgtttatctctttttatatttccgatcaatagaaagataaacgaaaaacagcgtatcgagatgggaactatgaatcttttcgcagctccaacagttcccggatcagctcccggccaaagatgggctcatactgccgataaacagggtcaagacgcttcatccattcttgtttctctttatctgacagctcataaatatgtatagcagaattctttttgatttcttccagctgctccttgttcatttgttcggcatacgtttcattccactccgtcgtctccttcatcgcttcagtcaaaatgcgtcttgtttctggtgtttgcgccttccagaagtgttcatcagtcatgacagcgtagccgaggtaaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcgccaagcagcttgaactgatcctcaatcacatcgctttgcataatgcgcagatcctgcccttttaaatcatccggtgttttgaccggcccttgatttgttgtgatttgcttaaagccgttcgtccaataggccagtccttttaattgttttttctttagagaatcaaacagctgtgtgccgatgcttccgttcagcccttttttgacggcattgtaatctgtaaatgcatacggcagatcaagcactccccattcaggcgagagcatgccgagcttcgatgtggagggggcgataaattgaacatcgccgttttgcaatgcttcaatttcttcaatgtccgagtacaggcttccattcggaaatacttctatttttattttcccgcctgatttttcgttcaccagatcagcgaatttattggcggccagcccttttggcgtattttcagcaaccacgtggctgaatttaaacacgatttgatcctgcaggccttcctggtcgtcatcataaacaatctttttattgcctgtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagctgttcgccatgcggttgaaaaaatcaggatgattaatgaagcagactatattgtcgtcatggatatgaatcacatccgatatacgcatcctgtcagcacaagcattggcaagaaatcagaaggtgcagacgaggaggcagcgtttgcggagcacatttatttctctgaagcaaagggcgagatcggcacggcggttcgcgctttttatccggttaaggatcaagacttgaaccaaataggcgtggtgcttgtcggaaaaacgctgccggggatcgctgacatcctgcttcatttaaagcgtgatatcgcattcatcgttgtgctgacactcggcttcggccttgctggttcctttttgctggcccgccatatcaaaaaacaaatgtttcagcttgaaccccatgagattgtccgaatgtatgaagaacggacagcgacgtttcactcgatgaatgaaggggtgatcgccatagacaatcgtctcatcattacgattttcaatgaaaaagcgaaacagatctttgaagtgcagggggatctgatcggcaaggtgatttgggaggttctcaaggattcgcgcctgcccgaaatcgtggagcggaacaaagcggtttataatgaagaaattcgtgtcagcggaaaagtcatcatgagcagcagaattccgatcgtcatgaagaaaaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggtctcatccagctggggaaatctgaaaaagccttgcagcttgcgttccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacggatgatatccttgctattttaatagaagataacggctgcggaattgatccggcacatatgcctcgcctttacgacaaaggttttacggtcaataaaactggcggcacaggctatggcctgtatctagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggagcgattgactatatcttaaagccgtttaagcttgagcgaatgagacaggcgctcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggtcgccaaggcgctcggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagacgttatgaaaacgctatcattctagtgagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgatcgcaccaatcattttcttcacaatcgttctcgggattgcaaaaatgggcgatatgaagaaggttggaaaagtagggggaaaagcgtttatctatttcgaggttgtcactaccctcgcactcattatcggtttatttgtcgtcaatattatgaagccgggtgcgggtcttgattacagcaagcttgaaaagggagatgtatcacaatacacgcaaaatggcggtcagggaatcgactggattgaatttgttacacacattgttccatccaacatggttgatgccttcgcaaaaggggacattttgcaggtcttattcttttctattcttttcggagtgggtcttgcggcattaggtgaaaaaggaaaaagcgtcattgatttcttcgacaaggtttctcacgtttttttcaaaattatcggctacattatgcgcgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttctgatcgtgcttggcacaagctcttccgaatcggtgcttccgcgtatgatggataaaatggagcgctacggctgttccaaatcagttgtcgggctagttattccgacgggctattcgtttaacctcgacggcacatccatttatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggaggggcttgcactcctgctcggggtcgaccgtttcatgagtgaaggaagagccattgtgaacctgattggaaacggaatcgccacgatcattgttgccaaaagcgaaaatgaatttgatgaagcaaaaagcgtagaggctgttgaaggcatgaaaaaaatgaaaacagcagtctgaaaaaagaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgattaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgccgcacagatccagcagctggttaagcagattaaacatattgcgtatcaccctgacagcatccctttctttgatgagatcaccagtgtcttcggagatattaacatcagttcatatgtcaaagagggcttcaatgtagtgtatacgtatctggccgatatcagcacattcggcttgcaggtcgtgatggcgctcattctcagcatgtttttcttatttgagaaaaaacggctttctgaattcatggcgaaatttaaaacgagcaaactgagggtcttttatgaggaaattgcttttttcggaagcaaatttgcaagaacgttcggcaaggtgctcgaggctcaatttatcattgcgctcgtcaactgtattctgacgtttatcgcgctttggattatgcattttccgcagctgtttgggctttcgattatggtgttcttccttgggttgatccctgtagcaggcgtcgtcatttccctgattccgctcagcattatcgcctacagcactggcggcggaatgtatgtgctctacattgtccttgtcatattcgccattcatgcgatcgaaacatatttcttaaatccgaagctgatgtcggcgaaaacagagctgccaatctttttcaccttcactgtactcattttttctgaacactttttcggcatttggggtttaattatcgggattccgatctttgtgtttctccttgatattctggatgtcaccaacaaggaagataggtctaaaggaccccgagagaatagcgataaaaagtagtttaaaatcgaataatgagtgtgcctcgatctgccggcctgcctgttcagggcatgagattaagattcggaatcggcgcttgatattgcttcgcacagtggtgaacacaacaggtgacaatgcctgtcatcagtacagaaactgaaaagaacaaacagtcggagcaaacgctcatcatcggtttaaccaaacatttggaagcaacaaatgctataatacaaacagtgcctaatgttgggcactgtttattttttgtcgaaaaaggaggaaggctttatggctgagccgattttacatattgaaggcctcgataaaaagattgggtctaaacagattttaaaacagatcagcatggacgtcatggaaggtgaaatcatcggccttctcggtccgaatggttccggaaaaacaacactcatccgtatcatcgtcgggctgttgaaacaaaacagcggaagcgtgacaatcagcggattccagcatgatacagagtttgaaaaagcgatggaagcggttggagcgatcgttgagaaccctgagttctatccgtacctgacaggctgggaaaacctcaagcactttgcgaatatgcacaaaaaaatagcggatgaacggcttgatgaagtggtggagcgtgtcgggctgacgtcagcgattcatgataaggtgaaaacctattcccttgggatgcgccagcgtctgggaatcgcccaggcaattcttcaccggccgaagcttctcattctagatgaaccgacaaacggcctggatcctgcggggatgaaggattttcgcgatcatattaaagagctcgcagaaatggaaggaacagctgtcctgttcgccactcatttattgcgggaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacgattgtagttgaggtggcaaaagaaaacataccggagctgaaccgatcacttgtcggacaaggtctgaatgtattttccattaccccttacacacagtcactggaagacgaatttataaaagcgacaacagctcatcaagaggagggagaagagcttgtctaaattgatttggaatgaacatatgaaactttttaatcggaaggtcactttggtttcccttatcctgatggctgtctttcaattcttcatggcattgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctcgcattattattcggtctcgtgttttttggcacatcggtgactgcggaatcaaagacattgctggtcaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttctatactggacaaaaagattaacagttgcggaaaaatggcaggaaatctataatacatattaaatttatcggaattaaaacttggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcctgtttcaagaacggcttgcacggggagatgctccgacggctcttagcatcggctggcatttgagcgtgatcggggagcttggagaaggcaacagctgggatgaagacgtatttgcatttgttgccaaggaagtccagaacggagctgtcattaacagggcggcgactgaagcgaaaaccggaagcccgacaagaggagggcgtcccggtacacacgccgtcaaaaaggatggcaaatgggcagtgaacgggagaaaaacctttacgacgatgtctcaagcactggattattttttagtaaccgcatggattgaagacaaacaaacaacaggcgtgtttctcattcataaagatgatcacggcttgtcgattgaagaaacgtgggatatgatggcgatgcgggcgactgggagccatgaccttgtactgaacgaagtcatgcttgatgagaataagctggtggaactgcttcaagggcctcgcggagctaagccgaatggctggctgcttcacattccagcgatctatcttggtgttgctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgacaagcgagctcggtgcggctaagcatatcgtcacaaacgctgcgctgtctgttgttgataaagcgatgagaattgtcggggccaaaagcctggaacgaaccaacccgcttcagcgctattaccgtgatgtgcgcgccggtcttcacaacccgccgatggatgacgccgtgatacacaagctggcggctgaagcgtttgagtgataaaaaaaagagccttaccggctctttttatgtattgttttgctcctgcagatttttttgatgcttgcggtcgatcctgtcataaataacgttcatcagctttggattgcccataatcgcctctttgttttcctggatcagctgttggtaagttttcactttacgcttcggcatgctccggcgccctcctgacatggttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacattgtccgcaatcgcctgtaaagatgaaaacagtcctattcttggccaatttacaaacattcaacaaatcgacaaaaagtttcccgggcaataatttgctgtcgaaatattccgcttcattgaacgcgtcctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagtcatcgggattctatatcattctgaagcgctgagagcagacgggttaaataatggaacagatattgttgcgtcagtagcagtgctgataggattgcggatttctcaaagaccggctgacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcggcgtccattaaaagctctgccctgatggcagcggcaaaggacagcaggtcagacgcttttgtaagtgccggcgcgtttatcggtgttttttcgtcccagctgaagctgccgtggattgatccggtaacggcttttatcatcggcatcatcatttgcaaaactgcgtgggatatctttaaagacgcttcacattccttaacagacggtttctatttaaaagatcttgagccttacaaacagaccgtcggcaggatcgaaaatgtgcatcgtctaaaggatgtgaaagcgaggtatttaggcagtacagttcatatcgagatggtgattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttaaaaataagcaggctgggaatgcccattacttggtatttttcagccaggtcaggaagctcgtccttattcagctcataccaatcgttttgattgtattcttccaaaatatcgccgatgaacatattcatgcgtgtgcagtctgggcaccaatcagcataaaactttacaatgatttctttatcggattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacggctctggctgtaatcaaagcgctaaatactgagaagtttgatatacatccgatttatataacagaaaaaggcgaatgggtaagaggcgcccgtttaactgagcctgtttcaaatgtgaaaatgcttcaatttgagcaaggaggcagtgctttttctccagctgccttgaaccaggagatgtttccgcaggaagcgtcacagcaaaatgaagccatcgacgtcgtattcccgctcctccacggaccgaatggagaagacggtacgatccagggaatgctcgagctgttgaacattccttatgtcggcaacggagtgcttgcttcctcagctggcatggataaagttgtcatgaaacatttatttgcgcaggctggccttgctcaggctaaatacgcagctttccttaagaaagactggactcgttcttcgaaagaatgctgcgagcaggttgaacaggaattaggctacccttgcttcgtaaaaccggctaacctcggctcaagtgtcggaatcagcaaatgccgaaaccgtgaagaactgcaaaaagcgtttgagcttgctttccaatatgaccgcaaagtcgtcgtcgaagaaggcattaacggccgcgagatcgaaatcggcgttcttggaaatgacgatcctaaatgctctgttgtgggagaaatcgcaccgaagacagatttctacgattacaaagcgaaatatgaggatggagatactgatctgatgattccggcgattgtgtctgatgaggagtacgcaacaatcagtgatatggcgatcaaagcgtttaaagcgatcgacggttcaggactcgtcagagcggactttttcctgacagctgacggcgaagttctgatcaatgaagtcaacacaatgcctggctttacacctttcagcatgttcccgctgctctggaaagaagccggagtggaatatgctgacctgattgaacagcttgtggagcttgcaaaagaacgccacgctgaaaaacaattgattaagcatacattctaatgaagaaggacactgccggtaaaagggcagtgttttttcccgtatatacaaaagaaagagagggaccttacttgattaagcgaacagtaaaaaacattgccgaaatggttaaaggcacactaacaaatccgcaatatgaacaaacagtcattcatggagtggcaaccgatacaagaaaactggaacaacatcagctcttcattccgctgaaaggggaacgttttgacggccacacttttgtggaacaggcttttgaagctggtgtagcggctgttctttgggatcggtcagaaccaaatccgcccgagaatcacgccgtcattttagtggacgatacccttaccgcacttcagcagcttgcaaaagcctatttgcaggagcttggcacgcgtgtcatcggagtaactggaagcaatggcaaaacgacaacaaaagatatgattcacgccgtactggggaccaagtaccgtgtccacaaaactggaggaaacttcaataatcatatcggtttgccgctgacagttttagcgatgcctgaaaatacggagatcgccgtattggagatgggaatgagcgccaaaggagaaattgacctcttgagccgcctggcaaacccggatgcggcagtgattacgaatatcggcgaatcgcatatgcaagacctcggctctagagagggcatcgcggaggcgaagcttgaaatcattaacgggcttaaagaagacggagtgctgatttatatcggggacgaaccgcttcttcaaaatgcatacagctgccagacgaaaacgtacgggacgggagcgcataatgattatcagcttcaggatgtcagccagagtgaggaaggaacccattttacaatcaaagggatagaaaacacgttttttattccgatactcggcaagcacaatgtgatgaacgccatggcagcgattgctgcaggggcttattttggcatcgcgcctgaggatgcggcaaaaggactgagcggcctaaaggtaaccgggatgagacttgaactcatcaaaacagaaagcggcctttcgataatcaatgacgcttataatgcgagcccgacttccatgaaagctgcaattcaattgacagaaagcctcgaaggctacggcaaaaaaatgctcgtgctcggtgatatgcttgagctcggcgatcttgaagaaacgttccataaagagtgcggcgctgtgatcagccctgagagaattgaccgcgtctttacgtacggaaaactgggagcttttatcgcggaaggcgccctgaaacactttgagaaagaccgcgtcagccattacactgagaaaaaagatctcctccaagctgtgaaggaaaacgcatcaaaaggcgatttgattttattcaaagcgtccagaggtatgaagcttgaagaaatcgttaaagatttaatagagagcccgctttcataagaaaatattttgcgaaaaaacgcatattgcatcataaaataacatgatatgcaaacactaatgtatgccggccgaaaattatgtatatctggccggctgcggctatgatacaatatatatataggttatttcgcgatacgaacatattcgtccggacttttcatcgtgacccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggccgtcttcttgaccacatcaaccgccgcacaattcgtttaaacaacgtaaataccgttgtaatggatgaagcggatgaaatgctgaacatgggattcattgacgatattgaatctatcctttcaaacgtgccaagcgagcatcagacacttctgttctctgccacaatgcctgcgccgatcaaacgcattgcagagcgcttcatgactgagccggaacacgtaaaagtaaaagcgaaagaaatgacggtttctaacattcagcagttctatttggaagtgcaagaacgcaaaaaattcgatacactgactcgtcttcttgacattcagtctcctgagcttgcgatcgtattcggacgtacaaaacgccgtgtcgatgaactggctgaagccctgaaccttcgcggatatgcagctgaaggtattcacggtgacttaacgcaggcgaaacgtatggttgcgcttcgtaaatttaaagaaggcgcaatcgaagttctagtcgcaactgatgttgcagctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcagcaggttactgttgaacgtcttcgcacaacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggtttttttatgttcgcgatttgttattcagcaaactttcagctgacggaagccatttttctctgtatgcttaagaatgaaacctttctgtaaaagagacgtataagtaacgacgaaaaaaagggaggtaggtatttttgagagagcagccaaaaaaccaaatcagtccagacggattaaaggtttggcgacttcaagagatcatcatatccgctgtttgcttgcttattgtcattgcagttgcagtgttaagctattattttcattggccgtactggatcagcggcgtgctcggcgcagtttggctgctgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcgagggtgactgacgatgatgtctgaaccgaaacgcctgcacccggcagcagtcattttgaatttatgccataccattattcaaacgataaaaaatatcattctgccattcttttttgtgtatattgtcaattcaaaccatactgtccgtttttacggagccattgcgctcggtgtgctgttcatctggcttgtagcggcaagcattatcaaatggagaaggtttacctatcgaattgaagatgatgaatttagaatcgaagaaggcttatttgttacgaaaaagcgatacatatcgattgatcggattcaaacaatgaatacgagtgcgggccttgtccagcaaatctttaagcttgtgaagctgcaaattgaaacagcaggcggaggcaaggaggcagaagccgttctttctgctatttctgttgaagaagcggaacgcatcaaagaagctgtctttaagaaaaaagcgcaaagacgagaaaatgaacttgatgaagaacggcttgaagctgaagaggagttggttccggccgttgaggtgcaagagcactatcgcatgaacgcgaaagaattgctcatggccgcttctacctccggcggaatcggagtcattatctccgctgtatttgcacttatttcccagcttgatgaagtgctgccaatggattggttatttgataaattttccttccttcagcacgccagcatcggtatttacgcggtactgatttttatcggtttatttatcgcctggattttcagcatcgcgggcatgatgtttagatacgcgaactttcaaatcataaaaaaagagcaggaacttgtgatttcaaggggaattattgaaaaacatcaagtcacgattccattgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttccgcacatgctccgaacatttacgccggaatatacgctggaagaaaactgccgccgcctgccgcggcgcgcgttgaaacgctatttgttccgttctgtcattttttcactctttttgatcattccgttatgtatcttctttcagccatggggctatctgtcagccatcctgctgccgatagagttgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaactggtactcatatgaaaaagcggacggttaataccgccgctccagcgtgtcggcaaaccctcgcattcgttgtcaggactgcgcttcggtgctcacgaatgagaacattcgctccgctcctatgctcgtccttcctagacttcaagggttttcaatcacgctgaaaagatgacaaaatcctaaaatgaaaaccattttaggattttgtcaacaatctgaagcgacggttaataccgccgctcttttttttgcacgcataaaaacgaaagaagaagcccgccgcatagtccaaacagatgggccatcatgttaatattggagttgataaacgacatgagaacggcaaatgcgagcagtgtgatgatcattttggaatgctcctgccctattagctcattgcgaaaaagaaccataaacaggtacacgccgaatagcccgaaaattgcgcctgaagcaccgacatgcacgtaatcaagcggctctgtaatataagtgccgatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaattggtgtgatcagccgccaccattcaccgtttgcgacacctagattatagcctgtgacggtatccctccataacacgactgaatgggcaggaagtgaaaaaaacagccagagaacagcttgcaaagccaatataaaggtgacaacggggtaaagcctgataaacgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctggacgccagaaaaggtttgccgagcggattttgacgcgaagcgagcttgaccaataccatgagctttctgagaaaagaaaaatcgaatttctcgcgggcagattcgcggcaaaagaagctttctcgaaagcatttggcaccggcattgggaggcagctcagctttcaggacattgaaattaggaaagaccaaaatggcaagccctatatcatttgcacgaaactgagccaggctgccgttcacgtatcgatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaatcaagtcattttacgaaatgaaaacggagtattcgttctcacgccgtctttaaataagagcttcagatttcaaagcgattggccaaacaacagcagccaggtttatctgtttgaatcgctcgtaaaggatgttcaaaacgattcggatgcagttttcacagcgaaagaaaagaaatacgtattcgaaacaaaaacaaactatcagcataacaaaatgctgccgacgcaagaaatcacatttaacaaaaaagatatgagcccgtcatctgtcaaagtgatggataccgaccggaaagtgatggtcaaagtagaattcagcagctttgaatttaataaacaatttgataaagaatcatttgatgaaaagaaaaatatgaccctttctcaaatggatgtcgccacaagcgcgaagccttccgatacatttgcggtcaaaacgccgctggaactgccgcttggcgtcaagctgcttgaagaaaaagatatatctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccctgtcggatgcatcattatcatggacatatgacggcgtagattaccttctctcttctaaagatctttctaaagaggaaatggtgacagtagcgaaaagcatgcagggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacctgatggcagttgtgaaagcaaacgcctacgggcatggtgatgcagaaacagcaaaggctgctcttgacgcaggtgcttcatgcttggcggtggccattttggatgaagcgatttcactgcgcaaaaagggcttgaaggcacctatattggtgcttggcgcggttcccccggagtatgtggcaatcgctgccgagtatgacgtgaccttaacgggttattctgttgaatggcttcaggaggcagcccgccacacgaaaaaaggttctcttcattttcatctgaaggtcgatacggggatgaacaggcttggtgtaaaaacagaggaagaagttcagaacgtgatggccattcttgaccgcaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgacatttcggacgagataccgtttcagctgcgtccggcatttaccctgcattcgacgctgtcacatgtcaaactgatcagaaaaggcgagagcgtcagctacggagccgagtacacagcagaaaaagacacatggatcgggacggtgcctgtaggctatgcggacggctggctccgacaattgaaagggactgacatccttgtgaagggaaaacgcttgaaaattgccggcagaatttgcatggaccaatttatggtggagctggatcaggaatatccgccgggcacaaaagtcacattaataggccggcaggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaatcagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgctgctgtctgttaaggacgaaaacgctgctgaaagccaaatcagcgaactggcgcttcgagcggtccaaatcggactgtctatgaagtttttggctactgcacttgctgaattctggaagcgtctctacacgaaaatgaatgataagagattgccagatcaagagagcacggaattaatctggcagattgatcgctttttcagcccgattaacacagaaatttttaatcaatactcaatctcatgggaaaaaacagtatccctgcaaaaaatcgcgctgcaagagctgtctgcgccgcttatcccggtgtttgaaaatatcactgtgatgcctcttgtcggaacaattgatactgaacgcgcgaaacgaattatggaaaatcttcttaatggcgttgtcaaacaccgttcccaagtcgtgctgattgacattacaggtgtccctgtcgtcgatacgatggttgcccatcatattattcaggcatcagaagcagtaaggcttgtcggagcaaaatgcctgctggccggaatccgcccggaaattgctcaaaccatcgtcaatttggggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaaacagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagttgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaattatagcggaagaccaagggccgggaattcctgatatccgaaaagtcatggaagacgggttttcaacgtctggaggacttggtgcgggacttcccggggtcaaaaggctgatggatgaattcagcttaaattccgtagcggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggctatggaatggcttatcaggagcatcaaacccttagagggatacagcaggaaatcaaatcagaaattgaaatcgcggcaaatgtccagcagacgctgctcggaactaaagttcctcaggaggaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcgatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactacaaacaattcgatcagcatctggaaaagggcgatatgattgttttattttctgatggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgccagacgagggtataaagcaactagtgattagtgatttgaaggaaaatttgaggtgatacgaatgaatataaatgttgatgtgaagcaaaacgagaatgatatacaagtaaacattgcaggagaaattgatgtctactcagccccggtgctcagagagaagctcgttcctctggcagaacaaggagctgacttaagaatttgcctgaaagatgtcagctacatggacagtaccggattgggcgtttttgtagggacctttaaaatggtgaaaaaacaaggcggttcgctgaaacttgaaaatctttctgaccggctgatccgactgtttgacattacaggcttgaaggacatcattgatatttctgcaaagtcagaaggtggagtgcaatgaagaataatgttgattacatcgaaatgaaagtgccggcccaacctgaatatgttggaattataagactgacgctatcaggggtcgcaagcagaatgggctatacgtacgatgaaattgaagatttgaaaatcgcagtcagtgaagcgtgcacaaatgcggttcagcacgcttacaaagaagataaaactggggaagtgtcaatacgattcggtgtgtttgaagaccgtttagagattattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaggcgcaggaaacgcttgtgcgggtgtatacaaatctggttgacatgcttgcgaaaaaatactcaaaaggcaaaagcttccacgaggatctccgccaggtcggcatgatcgggcttctaggcgcgattaagcgatacgatcctgttgtcggcaaatcgtttgaagcttttgcaattccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtcgaagagattgccgaattcctcgatgtttctgaagaagaggttcttgaaacgatggaaatgggcaaaagctatcaagctttatccgttgaccacagcattgaagcggattcggacggaagcaccgtcacgattcttgatatcgtcggatcacaggaggacggatatgagcgggtcaaccagcaattgatgctgcaaagcgtgcttcatgtcctttcagatcgtgaaaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcaatttgcggtgacagcttttttatgaaagctgatgataaggagttaatttgcgcggttgctgacggactgggaagtggatcacttgctaacgaatcctctgcagccatcaaagacttagtggaaaactatgcgaatgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttgaaaaaaggccaatcggtagaagaaatatcgaattcgctgaaaatgtatacgacatcgagaaaagatgacctgacctatattcttggacagctgtcctaagagaataagaacaagaagaagctggaataccggcttcttttttttatgtgtttttttcggtttttgatacactagagaaagaacgacaaaattggaggctttggttacatggaaacgtcagcccttttaaaacagcaaattgcgaaagaaataggtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgattgcagagcaggataaactgacagatgatctaaaacgtaaaatcgagcaatcggtgaagcttcaggaagtggaagacctttaccgcccttataagcaaaagcgtaaaacaaaggcgacagtcgccaaaagcaaaggccttgagccgcttgccgactatatcctgacacttccccaagatgatcgtctggcagcaactgcagaccaatacatcagcgaagaaaaagaagtgttcacacgagaagaagcgattgaaggcgccaagcacattattgcggaacaaatctcagacgagccgaccttcagaaagtggattcgccaggaaaccttcaaaagaggaaccattaagtctgcagccggaaagtcggcagacaccgatgagaaaaatgtgtatgaaatgtattacgagtatgaagagccaattgcaaaagttgttccgcatagggtgctggcaatgaaccgcggcgaaaaagaagacattttaaaggtagcgattgaaccgcctgcggatcacattaaggcgtatttagaaaaacaaatcatcaaaaatcgctcaacatccgtaagagagattttgcaggagacaattgaagacagctataaaaggctgatccagccggcaatcgagcgtgaaatcaggaaagagctctcagaaaaagctgatgaacaggcgattcatattttctcagagaacttgagaaagcttcttttgcagccgccaatgaaaggcaaaaccgttctcggtgttgacccagcctttcgaactggctgtaagctcgctgtgtcagatgagaccggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagagcaattcatcgtcaatgtactcaaagacatgccgcgcaaaatttattatgtgatcgtcaatgaagcgggagcaagcgtctattcggcttcagagcttgccagagaagaattccctgaccttaaggttgaagagcgcagtgccgtgtctattgcgcgaagacttcaagacccgctcgcggagctcgttaagatcgatccgaagtctgttggtgtcggacagtatcagcatgacgtcagccaaaaacgcttaaatgaatctctgcggtttgtcgtcgaaactgtcgtaaaccaggtgggagtaaacgtcaacacagcctccgccgcgctgcttcaatatgtagctggattatcgaagtctgtagcaggcaacgttgtcaaaaaacgtgaggaaatcggaaagttttcaaatcgaaaggaactgaaggacatcccaaggctcggtgcgaaaacctatgagcaatgtatcggtttcttaagagtgcaggaagggacagagcctttggatagaacaggcatccacccggaaagctataaagaaacaaaagcgcttttgaaaaaactcggactttcaacagaacatatcggcacggcggaattgaaggacaaaatcaatcagctggcgctttctgaaacggcaaaagagctgggaatcggcgaaatcactctgaaagacatttgtgaacagctgacaaggccggaacgcgatccgcgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaactgagcaatcaattcgtcaagcatcctcttgatgtcgtatctgtgggcgatatcgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcaccatggataatatagagcttcaaaagctgacagaggatatttctaaaacatattttaaaaagccgttccgccatcaggcgctttttaatgacaggcttaaaaccacgggcggaaggtacctgttaacctctcataacattgaattgaacagaaaatatctgattgaacacggcagggaggagctgatcggcatcatcaagcacgagctctgccattatcatctccaccttgaaggaaaagggtacaagcacagagacagagattttagaatgctattgcagcaggtcaacgcgccgaggttctgtacaccccttaagaaaaaagaggaaaacaaaaaaacttatatgtatatctgtacggcctgcggccaacagtatataaagaagcgcgccatgaaccctgacagatacagatgcggaaaatgccgcggaaaaataaaaagaattttttcgtgaaaaaggttgacgaatatggcaagcctatgttacattataaaagtcgtcacgagagataaataaaaacatttacctcttgacactgcaaattaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtctttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcaatgataccaagggttgtagacctttggtatttttttatgctctcttataattttaaggtttactcctttttacccacttgttagaataatgcatccagcttatcagcagtttctttttgtttattggaaaagagatgcaagaaaaatcagttgttgttctgatgggagcatgtccaagtcgttcttttattgtgatataatcttctctttgatcaattaacaatttgacatgggaatactttagctgtgaagtcaggttggttaaactccttctcaatttaagaaccgctactataaaatcatgtgaatagcaaagagggacttgtttattaaagagagaatgtgaagggaacgaataggaaaacatctattcatttgataggtaattatgaaaaaagagattatcttaattactgagtactaggaaaatacatgatgcaaatatatgtcaatgagctatatagaatggttccaagttacgatgcgattgtcgtccatataaggtcactaaaattagagaaagtctatacaaactctaaaaagattcaaaggtgattgtgtaaagtttaaaatctttttgtggggagatcttttgcgttttccacccgtacttgtttatttagctttctatccccctaaactagatattcttagtccaatattgataaaaagaatgggcgatcttcctctataacttccttaaacggacaccattctcgtaactctaccttctatcagtcgcgttcccaataacctggttagatgagcaggttattttatttcaactgatgaattaatgaagctgtactttgctctctttttttcttttgaatagattgcacagagtaaaacctataccattaacccctgcatatggtagcaattcacttttctgctccatattcatacaccttggttaactacggctactttggtacgcctccaaacctctgatctaatttgtacgatataacctaaataaaaagggctataaagaagctgcccttaaaaattttaaggacagcaagatgatataaacttcactataaattaacaaataaacaaacttatgttacttctgcctaaacagccaatactcacattggattgaattttattactcttaggtatatcggtgtcataaagtttctgaagtgaaagaacttttttcataatgctatacctccagtttattcattagattgtgaaatagtaaaaacctaatggaaatcttcattaaaaaccacctatggaagtacaagcgtatagacttactgagctgccttgaccaccctcacaaataaaaatactgagaactgactttttatcagggctgtcactttttttcgttgataatttttgaagtgacaaaattttatcagacattataacacctcctttttgattatgattttgtaaaaaaagtgaaaattttcacttttctccattgtaatatttcccatagggtattacaatataaataacttaaattgcctaaaaaagaaaaaaaagaaatagaaaggtaatgagtcatggataatatatgtaaacttagttttcaattaggaaaatcaaaagtgaattcattaggtagcgcatctattatcatatacaaagatgaattctttgttgctactgcagctcattgcctatacgatgtaggcagtaatgaaatagctaaaaacatatcaatagaagtagagaactgtggaatgaaagaatcatatgatgtactaaatatagtaatacctgaaaaatggattagtactcataggttaacttatgactatgcttttggatggattaaattgcctgaaagcatgaggaatgttgcttttattcctaactttgatttaagtgggatgatagaagagcataataaagcggttacattagcaggctacccaatttcattttttaaatctcagaagaaatactctaaaggagatttagatttaactctttttaaagaagagcagcttattggaatgagatccaaacttaaacatgggatatctggcggtccttggttttttgaaagtgataatgaaaaattccagattggtgttacatctgcaagaattaaaagtttcaaaaataaggtttgggcgtctatttggactaaagatacagaaagaatactaaacaagttattgacaagtgagatgcaagaaaaaattattctagcctaaagtgagggattttgatggatttaagatatgttgagtttttgagcccaggcaatttattttatgaattggtaacaccgaataaaatagtaaacaattatcgtatcccaaacttaaattctgaagagtggaaacaaaacacggatattaattggagttattgtattaacacaaagaaaaagatgcccaaacaaggatggaaaatacatatcactacagatattgatgaggcacaaaagactttagatattgtccttccatatctcattgaaaatgaaatatcctttaaatttgttcctaatgaaaggcaattattattcaaaaactctaaaaacggagacagagcatcttcgggtaaattcattacaatctatccttacgataacaagacttttctaacattactttcagatttagataatctgactaaagctttaaaaaaaggtccttatatattgaatgataaacgctggaagtattcaaatgtcttctttcgttatggagcatttgtatctatgtatgtgaataaagatggacaaaatgttccagcaattcagcgacctgatggcacattaattccagatgtccgtgctccatattatgaagttcctgactttgttgaagaacctgttgaaatacaaatcatgactaaaaaagttgatgcagaacttgataaagaagacacatcgaagtttgattcatacaatgttatttctgcactgcattttagcaatggtggtggagtatataaagttgaaaaaaacgggaaaacgtttgttatgaaagaaggaagacttggttcaggtttggatcggttgaaactagatggttttaaacgaatttataaagaggctgaaacaataaagcaattaagtgagaagccttacatagttgatttttacgattactttgagatttgggaaaataactatttgattgaagaacatgtatcaggaatttctcttatggaatatgtatctcaaaactttccgttttcatataaagaagataaagatatttatatggaacgcatgatgcatgtgatagatcagttgattgatgctttaaaagatcttcatagaagtaagattgcactcggagatttacagccaaataatgtattggtattagaggattactcaatcaaattaatagacctagaaactgctgtaactcccgaaagcaaatacacccccgccttaatgactcctggttacgttacggatcaagcagaaacttttgagcaagcagattggtatgcattacttagaatttgcaggtttttatttttaccgatagaaaatttatctgatctgtcaattgatattgaaataaatcaagataaatggattggagagaattttggggatgcagttttaaataaaattcaagaaattcaagagaagacattaccaaccatcaagaaattaagtgaagctgctactttaacaattccaccaatgaaaataaactacaagaatgttaatgagataactgaaggtttgcgagctggaattatgagtcatttaaaacctaagtcagaaagtttaatatccggagatatcaggcaattcattgaaaaaatgggcagtctatcaatcgctaatggaggatttggtggaataatggccttggatagaacagggactctatccgattcagtttatcaatgggttgatcatgtattggagacaatattgaatttagacacggaaacatataaaaatttcccgctcggtttatttaatggtatctcaggcatattgtccgttttatacgatattggatataaagaagaagcaattaaactgttagagacaatgcctttgccagatactgaagattcagatttaacactgttttccggattatcgggaattggattaaactaccttgccttttatagcattactcagaaaaaaggctttctagatcgctctataaaaataggaaatagaataatagatgcctataaagaagactgctccatcactgtaagggatccttatgcaatgccgtatggcttgttaaatggctggtctggaatcagcttgtatattctaatgttaggcaaggcgacaaatgacaatgacttaataaagctggctagcgaaattttcaataaagaaataagcaaaaacattgaaattgattctaaattagaattagcacaaataaaagaatattcattgggctataaaaggttgataccatatcttggtgaaggtgcagctgggattgcattaattatgcttgaattcaataaaaatcttcctgattttatgacagaaagtaatactgaactattcaaaaaactaactaatgttacagacttatatagcacatttgcaagtggcatctttcgaggtgtgggaggaatgattattcttgcgaatgcaatgaaatgtgaaggggtaaatacaggctcattagaatataccattaaagcactcgggaattatctcctgtataagaaacacgaaggaattttaagtccaggagagtatggttaccgactatctttagacttacaaacaggaaacagcggattactacttgctctttctgatatagatagtgataaatggagtagttggttaccgttacctaaaaacaataatctgaatctctttgaaatagacaagttcattaaaggaggtgaaacaaatgaaaaagctattatctcttcagcacaaagcacttgataaagaggttactctattaaaaggcaagtcatcagtaagcttaggctgcgataagatcagtacagttagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaaagattactcactgtttagactaaaggaggtaaaacaaatgaaaaaattattatcacttcagcataaagcgcttgataaagaggttactctattaaaaggcaaatcatcagtaagcttaggctgcgataagatcagtacagtaagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaaagattactcactgtttagactaaaggaggtaaaacaaatgaaaaagttattatcacttcagcataaagcgcttgataaagaggttactctattaaaaggcaaatcatcagtaagcttaggctgcgataagatcagtacagttagtttgtatttctgtggtaactaatgattatggacaaccctacttaaagaaaagagaggggatcatcctctcttttctttgtattacccaaaaagtaaatacaataaactatttaaaaaatataaaaggagttggatgaaatgtcaagaggaaagcaaatcagtaatatcctgaaattgcagagcttagaaagtggtccagtatatactgcaggagcgacaggaactgttgaaggtcaatcacttatttcacctgctagtatagctttttgtttaactcctcttcctgtcagtaccatgagtgcagctttttgcaataactaatctcttgagagggttgtaaatatggacttacgatacttcaaatactttatctcgacaaacaattctttttatacaaagcccgatacccctaacagggaatcggctttgtatatttctaatatacctaataattataaaaccataagagaaaatcattggattcatgttataaacaaagagcataaacttccaatgcaaggttggaagatacatataagtactacaatagattctgcagaaaaaacattagaaattgtatcaaatgtcctattcgattacaaaatctcttttaaatacgttaaaagcttatgggaattaagtattaaaaattcaaaatacagcaataggtctgctgcgggtaagtttattacaattttcccgccaaatgaacaagtatttttaaatttgttagaaatattaagcagtctgctagatactcttcctagaggcccttatattttaactgataaaagatggtacgaaagtaatgtatattttagatatggtgcatttttaagtatgtattattatgaaaataataaaaaggtatttgctattcaaagtccttctggtgacttagttgaagactcaagaagtcctcattattctatacccaaatttatcactgaacctgctccaataagagagatggataataaattagaaaacgaaatagctgaacctactccattagatgatatagaggttatccatgcaattcattatagtaatggagggggagtctacttagccctagataaactagacaaaaaagttatccttaaggaaggaaggccaaacattggattagatagtctgggaattgatgcctttacaagaataaaaaatgaagcgatgattttaaaaaaacttgaaggaacgcgttaccctgtaaaaatatatgatttttttaaggcgtgggaacataattttattttagaggaatatattgaaggcacatcactgagaacttggcttgcaacaaaatatcctttttatacgaatgaaacaaataaagaatacttaaaaacagtattaaaaattttgaatcaattaatagatgctctaactgaaatacataatcaaggaatagggataggagacttacagccctcaaatattattatcacatcagacgaaaatatacgattgatcgactttgagactgcaagttttattgatgatagtgtaccatcgggtttaaaaacatttggttttactggcgggcctaatatgacgagaaaacaagcggattggtttgcgttactaagaatatcgagatatttatttttacctatcggaccagttcaagatatttcttcaaaaattttagaggcacatgataaatatattgaaaattattttggcatcgaagctataaaaataattaataaaatacaaaaaatttgttctcaagttcaggcaaatccagctaaagatttattgaatgttgaacataaccatattaaagaaatgtcactaaatgaagtaaagatgttacttcaaaataatataataaataatttgtttgttgatgaaagggtaatcccaggagatattagacagtatgaattagaaaatggattatttaatatcttaactggcggttttggagctgtattagcctttaatagaacaaatatacaaaataaaaaactaaacgaatgggtaggtaatcaatctttaaacgatttattgaagatggaaaatggactattaactggcaaggctggaatagccactagtttatgggaatcaggttattatgacaaagcaaaacatctttttgatagcattaatcattttaaaaataacagtgatataacgttatcatccggactatctggaatcggtttagcttttttaggcctttcatatgaaaaagactctatcaaatatcttaacaaatctatagaaattgcaaaccggctagaggaattattagaaaaagacgtttcaatcgttccttatgatatggatataatacctcgtggtcttattaatggttggtcaggtgtttcacttttttattcttctttatataaaagaactaaaaatcataaatggcttattttatcgaaaaaagctattgaaaaagatttgatcactggtaaattcgatgattacggcgtttatcaattagaagatatcactagagtagtcccttatttagatggtggaagcgctggagtgggattggcattaattgaattaagtttacttttaaaggaggatttatgggagaaagaattggaaggtatttacaaaatagcgaaatcgaagtgtttttataattgtggattatttagaggtactgccgggataatggctgttagtaatgcaattgataaatattataaccggggtataaatgctgataatttgaaaactttagatctacacctctttaaaggaaaggtcgaaatatatactcctggagactttgggtatcgtttatcaaatgatatattttccggttcattaggattgttgctcgtaatacaaggtattataaacaatactaattatatgtggctccctgtgatgaacatcaaaaaagtatttgagtctaactcttaattatttatctccctcaattaagagtgtaggtagaaacttttctaatatttttttgaatatggatatccgaagtaaaaaaggagattattatgagacctaaaaaccccttattctttttattatgtaaaataaaacttccattattattaattttgtttgctatttctatttcatctataggcagcattagtggtttgtttatacctctatttacaggtaaggttgttgataaattttctgagaacacctttgattggagatttatagtaatttttttatgcatgtttttaattaacgcgatcttgagtggtattgggttatatttgctcagtaaaattggtgaaaaaatgattatggcaattcgttttatgctctgggaacatataatcaaattaaaaacctctttctttgataataatgagagtggttcaataatgagtcgtatcacagacgacaccaatgttatcaacacttttgtatctcaaaaattacccaatataataccttctataatcactattttaggctctgttatcattttattaagaatggattggcaaatgactcttataactcttattatagtgcctatatttttagcaataattatccctttaggcggaatggtaaggaaaatctcaaaaaaagcacaatccgaagtcgcaagctttagtggtttattagggcgtgtcttaacagaaatacgtcttgtaaagatatctaatacagaaaatcaagaattgaaaaatgcttataacaacctttttgaaatatataaattagggttaaaagagtctaagatcatttcaattatacaacctttaactagcctcatccttttactgactataggaattattctgggatttggcggtataagagtctcaacgggtgtaatatctgctggcaccctagtagctatgattttctatgtcatacaattatcaggccctttgactaatttttcaacgttacttacagactatcagcgtgcgataggagctagccaaagattaagtgaaattctacttgagcacaaagaagagctagagtccaataagaatgctttagatattgatttcagcaatcaaaatttgaaattttcagaagtaagtttcaaatatgatgataaaccgattttgaatgaaataacttttgatatcccaagtagaaaggttactgcttttgtaggaccgtctggttctggtaaaagtactattttcaatttaattgcacgtttgtatgaattacccccaagtaatgggagcatatcactcgaaggaataccgattaacgaatttaacttatcagattggcggaataaaattggatatgtaatgcaaaccaacgcaatgataaatggcaccgtaaaagataatattacttatggaatcaaaagagaaattagtgaagatgaaattattaagtattctaaattgtctaattgccatgaatttgttatgttgttagataaaggttatagcacaataattggcgaaaaaggagtgaagttgtcaggaggtcagcgtcaacgaattgatattgcaagaaactttattaaagatcctgatattctattattggatgaggcaacagcaagtttggacagtgagagtgagagaaaaatacagaattcactagaagaattaatgaaaaatagaactacagtaataatagctcacagattagcaacaattaaaaaagcagatcaaatcattttcttagaccaaggagtgattactggtaaaggaactcatgaccaattaatgcttacccatgaaaagtacaggcgatttgtgtcagcccaaaaattggctaactaactaaattacgagctcgcccctttaatctatttattagtaaatttaatatcatcatctaaatcatttatgttaaatgaattaagataccttacaaatttagtgtaatcttaacaatgtaagatgaggaatactttttgcattagttaaactgaaaagcagctaattattcggcatagtctgtggatgttatgttttgataagtagtaataaatattactttagctgtaatttgactgcatatactttgattgagaacataaaatggttatagaaaaagacggataacccggttttaaagtaattataaaaaggagttataacgatggtaaaaagattttttctggttttactcacactaattatgtctatagttgttatgctagtggctgctaaaaattctcctggagataatgtcatttcatttgaacagcctcgaatattaatgatatcaattgggatagtggtatttttattcattccccgttagtcatgtccttttttggtaactgggttgtaagaatcgtatctggtgtataccaatgttttatcgttctaacctttctggggctcattccaataggatttcttattcccgatggctttttgaccattgttgtttctattgcaggaactttaatcagcatagttagcgttgtagtaacctttattgataggaataaagaagttaaatcttagctgaaataataaaataaggttagaaggctttatccttaatttcaaggaaaggagctttctttttttataggtttatatgttgcgaatgactaacgcccttgatgacttatggttgcttttagtgtagatactcggaaagagagttacagggcgtatcttaacagttcctaaatctacagctcccaaattgttcatttacaataaaataaatcctctcaacgggctgcaatttcttgtccataatttctcggtgtccttgagattccaaaaatagacgcagagcttcggactgtagaaggaacggatgcggatgatttggaaaaaggagtcggccactacaaaggcagttattatccagatgaaaacggacaaattgttctatcgggtcatcgggatacttaccgtattccgccggacaggggaactaaaaaaaggtgatcaattaaaggttctgctgccatatgggagcttttcatatgaaatagacaaaacaaaaattgtagacaaaaagatacgtctattattaccctgcagcataacaaagaggagctcattctgacaacttgttacccgttttcatatatcggtaatgcaccaaagcggtatattatttatggaaaacagatttgagaaattcagaatatcaaagattaggctgacgaattttcgtcagcctttttcgtcaggttctttctgcattctggtccataattaaatcaaaataatcttagtaaacataaaagtattttatgtttttgtataagtttactttacttttatataaggtcgatttataatttggttcaagaggtgatggtcatgaagaaagattttggtgattcgatctcaaataaggtttatgaatatcgtgtacttgccagattgtctcagcaagaattagcaaagaaagtcggggtttccaaacaaaccatctttgtaatggagaaaggaaattatgttccgactctgctgttagcttttcgaattgccgaattttttaatgtggatgtaaacgagatttttacttatgagaaaggaaatgatcaaaaatgaaaatgaattcgatcacagatacgatcactaacgcaattttttctcctttaaagtcctgggctgaacattctccgggaaattggaatattcttattggcagtgggtttgtattgcttgtagtcggattgattctgacattcgtatttactaaaaaaatgggtaagactgacgaaagaacaaaccaaatcgctttaaaaggtagcctctgtacgttatgtgcactaattttttgcgacttgcttttcccaaaagaatatatgtggcaagttttcttcttatttaagtattctattgcattcttcgcttcagcaatctatctagccgttcgatataaaaaagattttttgtaaattcaattaccgagaaagatagtgtctctgctcaccaattattaaccacaattcatataaaccgttagaaatgaagtaaaatgaagttagaaaatgtaatgaaaacaagctttcataatcaatgatatggatttacaatgttgagggcccagtggggtgaataagccgtaaaggttcaagttctctcggccgcaccccaataataccaagggtttaaccatctttggtgttattttttgcggaaaatacggctgtaccgcattgtggagtccactaaaaaagtgctgacctctgcacaacatcgttgcgcgagtctgcacttttattctgcgattatggggagtttatttaatccgttgttagccgcgccgatacttggcttttagaagctttttttaagtggctaaaaccaacaaattttttgccttcttcatcccataggcggaactttaacgacttaaggctagttgccagtgtaatggtcggaacgttttgcaatggttcagtgttgttatgcactttttcaagcttatagtttgggactctcgggcttaaatgatgaacatgatgaaaaccgatattgcctgttagccactgcatgacttttggaagcttataaaaagagcttccttcaactgctgcttttacatattcccaatgctcatcttcttcaaaataagaatcctcaaacgtatgctgaatataaaacatccaaattccgagagagcccgatatcataaaaatcggcacctgaaccagcaggaagttttgccagccaatagcccaacataaaagtgctgccaaagcgacgatccccaggttcgttacatacgtattcatccgttctttgcgttttgccccttttcgattaaaacgattggcaatcccgaagacgtaaatcggcccaataataaacataacaaacggatttctgtacaaacggtacattatttttgtcttagttgaggcttctttatattcctctaccgtcagtacccaaatatcgcctgtaccgcgtttgtccagattgctgcttgtcgcatgatggacagaatggtcgtgtgcccaatgatcaaacggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaacgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattcaaaagtttccccttccctggtgatcttctaagtgtagaaaacgttttatagcctttggaggcccaacgttatacaccccatatatgataagtattcttcccattcatctgtaaaattattgtaaataataaactgatttccagtttattattagcagagtcagccgggatacaaaaggcgtatgaagattatacccagcactttatcgggtcaaactctctcaatgctccgccatggggatcgatttatttagatcgtgaacattgattgtttgaggaaaaaacggaatgaagtatggggatatccatgagtgactgtttggaaacatctgcagaaacaaagttttataagtgaacagccctgcttttaaaagattatcttgctcttgataacaagaaacagctgagctttttgacaaccattaatgaagtattattaagcaaagaaaaaggtttgaagccactcgtgattcacttttcacggtgttttcaaaccaaagtttttaataggtctcttattctgcgctggtatacacatgtttaacaaataatgccatgaataaatcagaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggctttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaattatttaatgttttgttcaaatataactctttcttttttcacgttcgttactttaagtaagattagatgaattataaaaatggtttcatctggatgtaatcaactcgcatatctcttttatgagaagaagataaataattattattcaatgtggcagtggatataagaaattcttaaaaataatgaggagatcgattgtttttttctcctggaaataatcacttagagatacctaaaacaatgaaagccctacctctcttccatccttacggctccttgtccgtgccagtgtgaatcagatactaaaaacaagtgactattttattgagttttttggtaaaacttcaatcttcgcagaagaaatgtaaataataaaaatggattagaatgtaggaataacaaaagaggtcgttaatgttctaaacataagttggagaagatttgcttttcatcataatattccgaaatattttttgggatcaatacactatctaaccgaaactttttatttgcttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacccgtttttattttgtccgtgtttattttatacctttgcttccatggcagtaacctatctgattctccatgctgaaaaatgtgcataatgtgttttaatgcaagtatatcggtaactggtcgtatattcgaactcaatattttacgcgttggaatcataacggtcatattactgattgacattcttatgacataatactgttgtttttcctctaagaattctttttcttctatggcttcaattatacctgctccgtgcattggataaacaatgttatcgccaatttgaaacatatcatccacctccatatatggtaaccttcttaagattaccatatatggaggtgggatatcaaacttttaataataacatgatcgaattttttatgtcaataactttttttaaaaaaacagatcaagcaaaaacaatagggaacgtgtcggatttccaatcaaggaaaaggtcaattgatccgtgtatatcctaaaacttcgactaattaacatagatcagtttttcattgaaaatgggttattcaatttcctttaggaattcatgacttggctcaatgacattacagaaatgatttgagtagataagaaagaacgatattcgtgaaatttcagctaaaaatatttaaagcacatgattaagttctaatttctttaccgatttgatatggataacggcccacttacttaatgatgcattttcacttatcttgcgaacagaaaaaggtttgttgataatgaacattttgccaccaaattggcattattatcagggaaattgacaaccttcaaatggtattgaggtgagaagaaaaataaagaaaggagggattataaatgaagaccagaacataaagaagtaaaggggaaagaacaaagttaattgaaaagcaaactatataaaatagtttgcttttttttgttatgaattcactctttttcttactctttaatgactaataaaacaccgctaagaattaaaaacgaacctatccaaaatgtcccgcctatttgttctcccagcagaatccatccgagtaaggttccaaccagaggctgaaaaaagaaaaagaggcctccacttgaagcatttaataattgtaagccgcggttccacaataaaaaagcacaagcggttgaaacaattcccaaatacaaaagaccacctagaattttagggtcatgcagttgtggcgtgaaaatcgtgctaggttttacaaaaggagttagtgccacaatggccacaaaagttgaatacgtggtaacaagtataggcgaatagctgtttggcacgcgtttgataagcactgacatcagtgcccatgtaagtgctgcaacaagcagagaaataccgccaagctgattagaggtatcaatatgtccgtttccaactataaataatacgcctgtggttgctaaaattattgaagttcctttttttatattcaatggttctttaagtaatagacgagcaaaaataaccatgaacgctggtgtggaggacgtaataattgctcccatttgtgctgaagacaacatcgttccatattcttgtgtaacaattgaaatggtgttgccaacaattccaatggccacaattaataaaagatcgcgcttatgaattttccaagattgtttccttattaaaccaacaataagaagcgcaaggatagcgatgacgtacctgatccaaaccaattcaaaaggcggaattactgcgacaacaaccttaaccacaacatacatgccaccccagatactagcggctaaagctaaatatatagaacctaacagggtatttttcattttttgttccctccgtatttaaaattaggtcaataaatgccctaacggagagaagtagtcactttactccattaagggcagagaagtgctactggaacatcattttcaaatagtggagctaaaaacatgttatgatcacctcgatttttaagaatgactatcattatacaatgttggttttaaagccgtaaacaccttaaggggactccatttaataatagaataaactttataaattcatttttttgtatgataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgtcttattcagcattcgtttaaaataacggcaacactcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccaggtttttccacattaacgttaattgcatcgtaatgtcaatctcatagagcgatgtcttttgttgaatcaattgatttatttttttaacagcatctagaatattttttgcccactgttgatttccatccaaaaataaataggacaaattggttgaaaacatataaggctgaacatagcttgaatacagttcttgagataaaacgaaatggggtgacacatttaagcaaatatacgtacaatccgagccatccttttcttctgccatgtgcaggcagccactattgataaataatccatccccttcgtgaacctctattttttcttcatttatttgaaagagagctatcccttttagtatcaaaacaaattggatttcatcatgccaatgaagcggaatatagccatttatattttgattgatcgttgtcttgtaacaggcaactggtaattctactgttcggtgctctgttaattcttttaaattttgatcgatcacaaaattcttcattctgacttctcacctcaatatatttatattttttcattcgatttaagtattttttatcatgttttgcatttattataacactattattatatttattagtgaggagtcatgtatgaatacttccaatagaagaatgggattgttctatgttataacaggggcgacatgttggggaattggaggcacagtagccaaaaaactttttcaagaatatcaaattgatgtcaattggcttgtaacgacacgcttgcttacggctggaatgttacttttaatgctgcaactgttcagaaaggatcggtctcaggttattgaggtttggaaaaacaaagcgtcggctggccagcttcttatttttggcctattgggaatgctagctgtgcagtacacatatatggcatccattcaacatgggaatgctgccgttgctactttattgcaatatttatccccagtaatcgtcattatctacacgcttttccgaaaacaaacggtccttaccaaacaagatatcattactgttgtacttgctttagtgggttgcttttttttgttaacaaatggttcaatatctcaactttcagtgccggcagctgcagtagtatggggagttttatcaggattcgcggcagctttttatactttatatgccgttggtttattacataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctttctcccaaagaaacaagcctattaggcagcttagaacctctatccgctgttgtaacaactgtcgtttggttaaaagcgccatttggttcttttcaatggattggtgctatttgtattatagggataactttaatattggctttacataaagagccttctatgcagagtgaaaaatctttattaaagattaggaatcatgcaaatcgggatatataggggctttttttgcttacatgaccggtccggcaatgaaaaacactggtggagtttgagccctctcggcagtatcaaaaataccaagggttttgacgcccttggtattttttcttcaagaaccttcaattcttcttctctgatcgaaaaacgtattacttttttgtaattggtatccaaatttcacttttaaaagatggtgatgttacatccttatgctcgttccacaatatttctggaccttctatttgttcgtaatttgacgatggaaaccattcggaataaatacgtccccatacttcttgcagtgtatccggaaatggtccgattgattcgaatacagcccacgttgaggcaggaacttcaagccgtgagaagttatctggacactgtttcgttgtggctgcgccaatatagtgatcgagctctcctttttcctctgtccgaccttcagaaaaattggtggatgcactaatgagtcctgatggtgctacattagaaagctcttttagtttatttattgctttttcatctaaactttcccacatagatgcaatctccggattaatccctttaaaaataataggaactctttttttaatgccagcgatgcgaaatgcctctttttcttcaatacggtagttcatttcatttcctcctttaattgttagctggaaggtcattcgtggataagctttaaggggatggccattaagtctggcttttgatgggtttatgccatgtaaattttggaatgcccgtgcaaaagaatcaggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcgttagtgaggttttcttcaatatactttaacgccctattcatacttttaagcaaatccatttatttgacctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaggcatcaataaagaaagttataattgtcttataagcagcacattcatataattgagtgaaaaaggatgcgtatcatgcctatcaattcttttgaaaactatccgatgagctggaagccatcgattgataaagctgaaaagcctatttataaagcacttgcagggcaattggaacaggatattttaaacggagttttattacctggaacaaaacttcctccacagagagaattggccgattatttagatttaaatgtgagtacgatttcaaaagcatttaaagtgtgtgagttaaaggggttgttaagtgcgactgtagggagcggcacatttgtatcgtatgatgcgttatcgaattcgtatttacttgaggatacaaagccgaaacatttaattgaaatgggagcaatacttccagatcacacttcctatgagcccttgttacaccaactaaaaaacatggttcaggaggaggattatgaaaaatggtttagctatggccgggcaggtgaaagcctttggcaaaaagatgcagctgtaaagctcatccaaagaggcgggtttgaaacaactgttgaacacattttatttgcaaatgggggacaaaatgcgattgctgcgactttggcgagtctttgtaagcctggagaccgcatcggtgttgaccatcatacgtaccctggattaaaaactgttgcatcattgcttagtgtgcaaatcgtaccgataaaatcagaaaacgatgaaatgagtccggagtcacttgaatatgcgtgtaaaaacgaaaatattaaaggtgtgtatttgatcccggattatcataatccgacgacttcctttatgtctgttgagaatcgaagaatggttgcagacattgcaaagaaatataatctatttgttattgaagatgcatcgtaccatcttctcaacaaaaatccgcttccggcactcgcctcattcgcaccgcaacaggttatccatattgcaagtttatcaaaatcgttagcgccaggtctgcgtttggcttatgtagcagtgccgagacaatataaggagccaatatcaaaggcgctttataatttaaatataaccgtttccccgctattagctgaacttactgctcgcacaattgtatcaaatcaatttgaagtcttaattgagagtcatcgtgaacaaaccattcgcagaaatcaactcgtaaaccgatatgttgcgggatatacatgtttaggtgttgaaacaggcatttttcgttggttgttgttaccgggtaaaatgtctggtgccgaatttgaagaattggctgctcgacatggcgtgcaagtgtatgcggctgaacgctttgtagtgggaaatagttgtcctgaaagggctgtaagggtttctgtctgtgcaccaaaaacacttgaagagcttgaacaaggattaatgatcctgagacgtttgctagacgatcttacctaatattgtttgccatacaattaagacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcagttcaccagaaaaacaaaaatcgttatacaagcgtacactattcgttgtgagtatctcacaaatttttggcggtgcggggctggcggcaggagtgactgtcggtgcgcttattgcacagcatatgcttggcactgatgcgtttgctggtctgccttctgctttatttactttagggtcagcaggatctgcattaattgttggaagactttctcaacgttatggccgtcgaacaggtctttcagctggctttatgattggcggacttggagcaataggcgttattatggcagcaatcataaatagtattttcttgttatttatttcgttgcttatttacggtgcaggtacagccactaatttacaggcccgttatgctggtacagacttagcaaatcataagcagcgggcgactgctgttagtattacgatggtttttactacatttggcgcagtggcaggtccaagcttagtgaatgtgatgggggatttcgctctttctattggtgttccatcacttgctggccctttcattttagccgcagcagcatatatgttagcaggtgtggtccttttcattatgcttcgtccagatccattagttatagcaagaacaatagaagcggcaaatgaagagcctggtgataaaggacatttggcggcagctgagcatacagaaaacaaaaaagggataatcgttggggcaacggttatggttcttacccaaatagtaatggtagctattatgacaatgacaccggttcatatgagacatcatgggcatgacttgggggcagtagggcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactgggattagggtggaattttggtttgataagcgggactgcccttattgtagattcaactgatactgccacacgagctaaaacgcaggggacagtggatgttctgattgcgttgtcaggagctgctggcggggcactatctggaatgattgtggcaggttcaagttacctcgcattatcacttattggagggattttgtccttattactcattccggtggtggtatggtctagggaccgctaaaggataggattgtttaatttacattaatttgttatattgttagataaagtctattgcgtcgtctaataatctaactaactatagttgctccattaaatctaaatcagcaattttggtataaagatttgtgaccaggattccttatagctgtgtcactcactgcatattctttaatagaatcacataaaatggttatcggatttgaaaaaggcaggattactcgctttaggtaaaggagtcatcacgttgttaaaaaggttttctcttgtttttgttacactaatgatgtctatacttgttgttttagcggccgctaaagagtcgcctggagatcatgtcatctcatttgatgaacctcttatcttgatgatctcaattgggatcgttgtatttttatttatccctccattagtcatgtccttttttggcaatttggttgtaagaataatatctggtgtataccaatgttttatcgttttcacttttctggggctcattccaattggatttcttattcccaatggctttttgacaattctagtttctattgcaggaactttagtcagtatagctagtgttgccgtaaccttatgcattggcaagaataaaaaagatatataataattgaattgttattttttcagattgtcagtggaataataaaacaagatgagaaggctttgtgggccttctttttttatgttgtggacatggatatagcccatgatattttttgttgttgcatcatcctcactttaagcttaatctattgaataataagagaaggaacctatagaagaataaaataaataccgagatgtcaaaaataaaactggacttcattattatcaattcacgtaaatgtaaaaagcttggaaagaggggaattccttcatgacaaatagcagaacgaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggtgccctattacaggatgcccatggaattctcattcaacaaacggagaatgtacaggcggcgcgccagattcggtttacaaatgttcaggaaataaatgagctagaaaacattttgaaagcctatattcacgaagccattgaagttgaaaaagccggtttgaaagtggaagttaacaaaaatattgaattgaacattcctgaagaacttcaaaaaaaattcgatgaaatccctgcattgaaaactgcttttgaagcattgaccccgggacggcaaagagcatacactctttatttttctcaagccaaacaatccaaaacccgagaatcgagagtcgaaaaatatgtgcaaaaaattctcgatggaaagggattaaaggattagcccgccaaggttcaggctaaaggaatagcatcatagcgtaataagatactttctatagaagaaaaaacaagcatagtaagatgcttgttttttcttaggacaacattcacttactgctgaaatgcttcttttgattaacattgtatgccactagacagcgttataaaatattaatgcaacacctagaaatagctcaatggtacggctcatcacatttagaatgcctaggagaactaatagaaccggaagatttttagcaagttactgcactccaaactttgttttttgtattaatataccttattaaccattgtttttagtcaggtgcagacaaacgaatactaattaatgaatcatcatgatatcaatgagccgcttgattttttcattgtcacctgtatcaacatacactgtttttctgttttttatgatattctcagtcacttccctcatgacgcctttttctaaatcatcagcggaatcccagcgtaaaggcacattatatacatgaatcgtgccatccccattgccatgataagtgactgatccatccactaaacgagaacctgctaactgggtcacatcttctggatagctggcacttgtatcatcattaggattaattggctcgccagccgaaatatgtcgaacatttaattcatctatctcttgattaggtccaagttgaagccaaactctggcatattcgattttttccgaagagtatgctgccaatacattgtcttctttgcttttctcttctgctgaagaggtattatttgcagcttttgttgcggattcttctgattctgttattggctccgcttcatccttgtgtattttggtgctctcttcaggctcagtgtgtttttcgtcagattgtacagcagaagcttgatttgaaggttgatgtgcttcttcatccttactgcccgtacatccagcaagcaaaatcatgagcagcagggcagtaatacaaaaatatatctttctgtgtttcttcattctttcattcattcctccctctccattaactcaggtcagcttcatatataagtttatgtatctaaatattaccatggaatagataggatgatattgaaaactgtttaagaagaggaaacgatcttgaataacatcgcgaaaacttaagaattcttaagaagttttgcccctttttctgtgttttcaagcgggaacatgatgaaggatttagaacgtaaatatccagagttgaaaaaattattggagacttacaattataagtttttggcgctggggatgatttgtccaatagctccaacagatgtcgtttgttttttatcggcagctgtaggaatcaagtataccacttacattttaacggttatcgttacgaatatccctttattgatattttcgagtttcattgtgatcaattttagtgagtgattaatgggaactgtattggttgtcgcatcatttgttttggtttctattgtatccattaaaatgtggaacacccttaagcataaacggagcacatagaaatgccacgggactaaccatttatagcttataagcacctgtagagatttaagttctttcggtatccaataataccaagggtataactgcccttggtattatgttctgctgcacatatataaaccctccattttcgtttgtagatcctttttaatttttgtattttaggttgaatgatcaccagaagaaaaatgaacgcatgatctgaaaagctgttttgccgcaaaataaattaacgataacaatcccgctactacgatatattgtgtgtctgattttgattactgtatataagcgttttttagtaaatgctctttcattttttgaattgccttcgcttcgtcggctccatgagcgtatatatgtatttcggttcctggtttaattcctaaatccataatgtccatgatggcttttggcgcttgtttgaggttaacagttttcccttggtattcaagaaaaatatctgatgtaaaccgatgagctatactgactaacagggtagctggtcgcgcaaaccctgtttccttaatgatcgtaaattgtcttttaatcattcttcacctcattacattctgcctcttgacggatttatagttgggctgcagatcaaatttgaatttagagtacctttaggataagtgatctaatttcatcattttctctgcattttgaaataacaccctttctttgtgtttacaaaataattctcaactaactaaaatggacaatgacttcattcgagaaaaaagcatgattcactaatcaacatttgtttattattgtaaataaaaacttggtgtgtacaatggttacattcaggcgatttgttgattattcaacattccactctaaattgttgattatcttaagaaagtttggtgaaaagctatgtccaaagtggatagaagaataaccaaaagccaagaggctattaaaatagctctgattgagctgatgactgaaaaaagttttgatcatattacgattaaggaaatttctgaaagggcaaatgtaaaccggggaacaatctatcttcattacttagataaatttgatctattagaaaaaattatggaagagcatataaacaatatgggggatttttgtgagtcggcagctgaaatggactggattgaatcgactgtacactgcatggaataccttgagagtaattatttattcttttcgacgatgttagccagtgaaggcgctcgatattttcgcagtcagttccttaagtttaatatcgaagagttcaggaaagatgtagatgtaacgaaaggcaagaattacggccaaagtgaagatgtcattgttgaatttatagcaaatgcttacgtaggggtagtggaatggtggttaaaaaacgaaatgccttatccgcctcgtgtcatggcagaaaaagtgggggagttattagagcggattttataatggaggtaggaaatgggtgttgacttatttgtctaggcgggagattcaagtctcctcgatcgcatacaaaataccaagggttgctggcccttggtatttttatactttcatgcatttttgaagtttatgcttaatggtctgccttactttgcaaatcgccgagctgcggcaacgcacatgataacggcgatattcactgctacgagtgcccagcctactttctcgtgcagtatcactgaggcaagcagcagtccaaaaaaaggctggagaagctggagctgcccaaccgctgcaattcccccttgggcaagacctcgataccagaacacgaagccaatcagcatgctgaataaggatacatatgcaagactgagcagcgcgggaacgccgatcgccgaccatgagtccggcgtaaaaaagaacgacaatggcagcataagaggaagcgacagaacgagtgcccatgagatcacctgccaattccccagacgccgtgaaagtttggccccttctgcataaccaagaccgcatacgacaatagaagccagcatgtacgcgtcgccaagcggggatgaacctcccccctgaatgagggcgaaacctgctactaacaagctgccggcagctgagaaaatccagaagacggggcgagggcgttcacccccgcgcagtacgccgaagactgccgttgcgagtggaagaagtccaatgaagacaatggcgtgtgcggatgtgacatgctgaagcgctaaagctgtcagcaacgggaaaccaatcactacgccaaacgctaccactaataatgaaatgaggtctcttttggcaggatgctgctgccggaagatgagaaggagacctcccgccagtacaccagctatcgcagcacggcaaacggtgagaaataacggatcgaagtctgacacagccaaacgggtcgcaggcagcgagccgctgaaaatgagtacgcctataaaaccatttatccagccatttgttgttttgttcattataatcactccacatatctttcttgttcattgtctgtattttcttaacaaaaccagcagctaaggattacaatgactataaactggaattggccttttttaaacggccagttttcataaaaaaatgcataccagttaggagaacaacgtgcaaatggatatcacgccttttttgaatagaactctggatattccgctttatcagcagctttatcagtattttaaagaaaatatgcatcggggccgtattcaaaaaggaatgaagcttccttcaaaaagactcctggcgaatcagctttccatcagccaaacgactgtagaacgtgcctatgaacagctcgttgctgaaggttatattgtgagcaagccaagaagcgggtggttcgctgattatcatgattctgattttgcttatgatagaatgccaagcacaacacccattcaacaagaagcagaagaaaataaacaatggattgattttcattatggaaatgtagattcttcttacttccctttttccgcatggcgaaaaagcatggtcaatagcttagaccaatatggacacgagctttatcggccgggacatgttttaggagagtttgaggtgagaacactcattgcagagtacctgtatcaatctcgggggttcattgcggccctgaacaagtgattataggtgccgggaaccctattctgctgcaaatcttgtgccaagtttttgagccgaatatttctatagggtatgaggatcctggttatccaagagcacgcaagatttttgaagccaaccgcatgaatattgttcctataccagtcgatgatgaaggaatctgtatacagaaggtcaaagaacagcagccaaaccttgtatatgtcacaccttcccatcaatttacgctgggaaccataatgacaataaacagaagaattcagctgctcaaatgggcggccgaaaatcaatcctttatcatagaggatgattatgacggagaatttaggtacacaggacagccggttccttctcttcaagggcttgatcagcataaccgtgtcatttatatgggcactttttctaagtctcttttgccctcgctgcgtatcagctatatgattcttccttcacctcttttaaaaaaggggcatgaaatcacgtccttatataagcaaacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaatccgcggagaaaactctgggcttcgtatcttacttgacgtttatttgccatttggtgaaaaagagttaattgagaaggcgaaaaaacatggagtaaaaatttatcctgtttctctttcttatcaaaatcatcctcctacaaaaacggtctcgctcgggtttgcaggggtttctgaatccgacataagagaaggcataaaaaaactgaaggctgcctggaagatatgagggagctttcagtttagcaaaacggccaagtgacggaactaagtgttgagagctgttcaatattttttaagtatatgatgagtgccagcagtccagcccacgatatgtctgtttagcgaaaaacagaattttttatttgctcatcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgagtaaaggcagatttaatggaattatcgcttccggcatacaaacactggccatatcttttaaactttggattgaagaaggtctctatggagacgatattatagccggaacagagatgaatcatatgacattcataaaacccgtatatccggatgatgaattgtttacaattgttgaggttcttgataagcagccaaagagaaatgaattgggaatactcacagtcttgttatctacttataatcaaaaagaagtaaaagtgtttgaaggtgagttatccgtattgatgaaacgataactcagaaagcccgcttttcgcgggctcgattgaagcagatgggtgaaagatgttagcgggtttcttttgaaaaataagaggttaaaatatcataaacaataggcaaagaagtaaacccctcattttctagaaaatgacccccgtgctggacttcgtataacgcagcgtcaatttgttgtgccagctccttgctccatgaaaatggaacaatttggtcgttcttagaagcaatgacagcacggtgcttcgcggactcgatgattttttgatgatcaaacgatccctgtgtaaattcatctaacatctgtaaagtgggcaacgatttggcaaagccggaaacaagtatgattccgccaagctgttttcgtaattgaatatgttccaaaaatctcaaaatggcagggcaccctaagctgtgcgcaaccaaatacgtattttcgtgtaaagtgtgctgatataaagagagtgtatccagccaatcctcaagtcttggctggagcggattaggcatgtttaaaatgtctgcttggaccccatctgcgagcagacgttttttcagccaagggaaccaatgatttgttgaggaggctctgtagccatgaatgatatagacttgttttgtcattatttcctcctaagaaatattttcattcagtataaaattcctctcattgggaaacaagtacgcacttttttgtaagtagctttatatatgaggcactccttgtgccattccccacttacacatctcatctatgagggggtacaaagatcgccctctgtcagataacgaatactctactttcagtggggtttgagaaacctcagaccgatgaataaggccgtcagtttgcaattccttaagctgtgcgcttaacattttatgggtgatgaagggcatagcccttttcagctcgccgtatctcatcgttttttcacaccctaactcatagagtattctcattttccatttgccccctataagagacaaggtgtattcaaatggggcttgtttactgcggcacaggctatccatgtaatcgaacctcctttttaaggtatcatatcagaataattcaggattttcggtgttgaagtttgagggcgattcgcgatctgaactgaaaggaacgcttgctcaacaggcggcacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacacccaaaaaacataagaaatttaaagcgaaaatgattctccaaatcatcatggttatcattggaggaatcatagcggcatatggactagaaacagtgctcattccaaacagtgtatctgatggaggagtgacaggtcttagcatcgttggttcacagctattcaacttgccgctggggattttgattgctgtgatcaacattccatttgtctggttaggatataagcaaattgggaaaagctttgcattattatcaattatcggaatcgtatcgcttgccgcggggacaagctttttccaccacacacccgctatcatagaaggagataccctgttaattaccgttgtcggcgggattatccttggattcggaatggggctggcgctgcgtaatggcggcgcattagatggaattgacatgcttgctgtgctgctatcccgaaaactgccattcggaacgagcgatctcattctattcttaaaccttttcgtgtttatttttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaatccgcctttgtcaccgtatatgacgtagctgaagtgaagggcagcaattttagaagtcttaatcatcattaaaaaatagaatgacctttttaaccgtaattgacatgccgcgggtaatttaatcaaaaacactttttgaggcttgtgggtgaataaccggtgaaggtctgaatcacagaaataccaagggcgtcaaaacccttggtattttttctggttattagattttatcttcagctttacgtgctgcttcgagcttatcaatcctgtctttatatttttctccccagtccttcatgtgcaggataacaggttctaatgttcttccaaactcagttaaagagtattcgacttttggagggacctgtttataaacctcgcggtgaatcacgccatcccgttccaattctcttaattgtagcgtgagcatacgctgggtaatttttgggtatagttttcgaaactcattaaacctctttttaccgtcaatgagatgataaagaagaatgcctttccacttacctccgatgatatctaatgttgtctccaccggacatccttcaaagtcatcagaagaataatcaatgccgagtttacgatttctcaagctgttcactcctaatagtatactttttgatactatatacattcaatgtgcgtactttttatattttaatatacatcatataatgatgtcacatctaaggaatgaaaggaatggatcatatgaaaacactcgtactcgttgtacatccgaatatagaatcctctcgtatcaataaaaagtggaaagaagccgttttaagtgaaccagatgtaactgtccatgatctttatgaaaaatatcgcgatcaaccaattgatgtggaatttgaacaacagcacctcctggcccatgaccgtatcgtttttcagtttccattatactggtacagcagcccaccgcttttaaaacagtggtttgatgaagtgtttacgtttggctgggctcatggtcccggcggaaataaattgaaggggaaagagtgggtaactgccatgtccatcggttcacctgaacactcttatcaagccggcggatataacttgttttcgataagcgagctgacaaaaccgttccaagcatctgcccatttagtaggcatgacctatctgccttcctttgccgaatatcgcgccaatacaatcagtgaccaagaaattgccgaaagtgcgaatcggtatgtaaagcatattacaaatatcgaattaaacccgaaggttcgcctgcaaagatatttgaaacagctggagggtgtcgatttaacataaagattgattttggaaaatcctgtactcaccaagcaggattttttcttgttcagcagagggattttaacatatagcgaaaaaagaagaagccaccaaaaataagctatttgcttggtcctgactgcttatttttggtgaaagacttatttctctgtgatgaaataaagcaaagcgatgaccggaaaagcgattccaatccataatgctgtactccatccccctgaggcatatgcccatcctccaattgatgaccctatcgcaccgcctagaaagaagatcgccatgaataatccgtttaatcgactgcgaatttcaggcgccaacgaaaaaatagcacgttgactgagcacgaggtttgcagatacacccatatctaacagaatagctgcggccactagaactgttataccgacgggggagctgctctgaatcatgagcggcagtaataaagagacaacgacaacaccgagagcgattccagtggcaagccgggtcaagcctcgatcagccagccggccgcctattggtgcagcgactgcacccgcaatgcccaccaatgcgtagagtgctattgccttctgagaaaaatgaaaatcaggaccggacaataataaaggaacggtagtccagaacaagctgaaagctccaaatacaaacgcatgatagatggcacggcggcgtaagattggagtcgtgcgcagcagcttccaaattgaaccgagtaaggcagtatagtttgtatttgctgttggttttctggcaggaagcacttttgataatacgatggccaggataacacttaccacggcggacaaagcgaatattgcattccacccccagatatcagcgactagactagatatcggacgggaaagcataataccgagtaataagccgctcatgacattgccaacaacccggccgcgtgcagcgtctgatgcaaggtatgatgcaaatggaacaagcacttgggctgcgattgatcccaatccgacgaaaaacgcagctgctaaaaacagtgttccatgcttcacaaatgctgttagtgtcaaagccgctgcgcttagaaggagcgatacaacaataagttttttgttttcgataatatctcctaaagggacaagaaataataagccggcaacgtatccgatttgggtgagtgtgacaatcaatccagcactgcttggagaaagtccaattgccttactaattaatccgaccaagggttgtgcatagtaaagattagcaacaatgataccgcatgcagttgcgagaagaagggttaaactgggtgaaatcctctgacctgcttgtttgtttccattagccataagaatgaactcctttttaagtggttttttgagtgtaatcatgacttctcaacacaagtgattttataaactgaacgttcagtttcattgattaaggaaaataatatactaaacgttcagttttgtaaataggtttctgttttctttttttattcagattaagtatactgaacgtatagtttatattgcgggaaggaatgattcatgtgcagagtaaacgagggcggccgcgtgatgaaggaacgcataaggcgattctctctgcagcctatgacctattgctggaaaaaggcttcgatgcggtgacagtcgataaaattgccgagcgtgcgaaagtgagtaaagcaacgatttataaatggtggtctaacaaggctgccgttatcatggacagctttctttcgaccgcgacggacaggctgcctgtgcctgatacagggtcgtcagtacaagatatagtaacccacgccacgaatttagctaggtttttgacaagccgggaaggaaccgttattaaggaattaataggtgcagggcagttggatgaaaaattggcagaagaatatcgcacgcgatttttccagcctcgccgcctccaagcgaaaggccttctagaaaagggaattcagaaaggtgaattgagagagaatcttgatattgaagtaagcatagatctcatttacggaccaattttctatcgtctgcttataacaggggatgaggtgaatgattcctatgtgcatgatttggtgatgaacgcgtttaagggagttcaagctacctctgctacagagagtatgtagctgataagaactgcaaaagctacggattatatgacaaattggttccatcgtacgtgaaatataagatttttgttgctgagcggaatcatcgagggaactcttatcggatgtcgaaaaagaagtcattcaatcgtgaatacataacatcatattattacatttccttttcatcgattggaacaagggttctatacttcaatggaatatcgcaaagttggagtatttaaagaacaggggaaaatcgatggccattatgtaggtgtcatggcaatggaaaaaatacttgcaatgtaaacaggcctctaaagagacctgttttttaatatccagaggatctgtctattttcatcttgggctctatgactactcccataactgaaatagtctaatatttataccggaatatttgatgttccaaatataagggattgtttatataaataaaagtttatataatgacgggggcgctaaggaaacgcggggagcgactcaggttttcgtttcaaagttttgatccttaagatatacggagcgctacatatggaaacgtaaaggggaatgtataatcatttggcgtgtatataacgatttgcttatatattgatttgggaaggaggagctcatatgacgattgatgttgcggcgatgactcgttgtttgaaaacacttagtgatcaaactaggcttataatgatgagattatttcttgaaaaagaatattgtgtctgtcaattggttgatatgttggaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgaccttggcttttgtggccatcatactgatatcgttaattcttgataatatcggtttctttgaatgggcagcgcttcatatggctaaggctgcaaaaggaaacggtgtgcggatgttcgtttatgtatctctattaggagctatcgtcgccgcgttatttgcaaatgacggtgcagctcttatattgacaccaatcgtattagcgatggtcagagcattacattttaatgaaaaattagtttttccttttatcattgccagcggatttattgcggataccacttcgcttcctttagtagtgagcaatttggtcaacattgtttcagcggactattttcatattacgtttattgattatgcatccagaatggttgtcccgtacctgttttcgctgctggcgagcatcattgtactttaccttttctttagaaaaagcataccaaaacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatactaagaaagtggtgaaagaggcgccatgggctatcgtattcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggctattgccggtacagatacacatgggatgatgagagaagcgcttatttatgcaaatgtgatcggttcagatttagggcctaaaataacaccgattggttccttggcgacattattatggcttcatgttctttcgcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaataatgcactggtaactcttgccgcagccagatggctgaagggtgggggagaaaataccttggggacaagtggaatgtgtacagcgcaggaatcgaagctcatggatgacatcgagtgctgtcaaagcaatgaaagaagcagggattgatatttcaaatcaaacatcggataaatttgatgatccggcaaaagcacacggaacagaagaagtgtttccaaagggtatgtgatgaaattggtgaccgtttaaaacagtttgctgtaactggggaataagaaatcgatatactcagcgtttccttgggtttatataatgcaatgtgttgttcaacaggtgtctgcgagctgagtgcagacacctgtttttatttgtctgagattcgtaacagggaagttatttagctggtgacagaggaaaattgatttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttgaaccaaatgagaagagctgcattttcttatcaaccaaaatctttcaaaaagactttgcaactgccaaaggggcttgtattgaaaagaattgacgaagacatcatttcacacagcacagcgtttaacagcgcgtattatgaggagtattggaattctgtctcacagtttgcttcaaaaggttttggatttgccgtattacatggcaatcacgtagtaagtgagtgtacctctatatttttagggcataatcgagcggaaatggatatctatacacttgaagaatatagaggactggggttagcttattgcgtagcaaataggtttatagcgttttgtatggaaaatgggattgttcctagctgggattgtgatatttgcaacaattcttccattgcattagcagctaaactagggtttaagaaaataatcgaatactctcttttttattccggtaaatcataaaaaagagaagaggcaagaactcttctctttacatgagtaagcggttggtgaataccggtttttattttattaagaatctagatttaattgctggcgaagtttcttcgataagtcctttctcgtttcatcagttacaacatgataccataagtgatctatctttttatcctcaccttttatttcgatctgtttgacatgttgaacggcttctttataagagcgttgaatatcaatcattttatcaagtgttaagtttgtttgtatatttttttctaaggcagccaaaattccttgatagttttttaatgattttaattgtgctccttcgtgaataatttggttaatgatttctcgctgccgctgctgccgcccaaaatcaccgcgaggatcttcttttctcatccgtgcgtatttaagggcaacctttccatccaggtgctgttccccttttggtatatgcaccccttcaagggtaaaagggaaatcattattcactgtgattccgccaatctcatctacaatatctttaaacccttccatattgactttgatataataattgattggaatgtttaaaaattgttcaacggtttgaacggcaccttcaataccctcgtaagtatatgctgcgttcattttaatattggtattctttgatcgcataaatactctggtatcacgcggtatacttacgatcgtcgatgttttcgtctctggatttaaagtcagtacgatcatcgaatccggccgtcctttatcaccggggcgctcatctactcccagcaaaagaatcgatataggatcatgtccaagactagcatcttgttgcttagaatctctttgcagaggttcatacatatggttgaccgattttgctacgtttcggtaaatgctatagcaggtcaggcctccaatggttaacaagagggctagaacaaacaataaaatactctgcattttcagtttccttctcccgattttcactatcaaattcctttctgatcaagttgaatatttatatgttgtactggttcttaacggttctctaataaataattcttttatctccgtgatattttgtagttcatataagatactttaaatttatacttcaattgaatctgaattgtaccggtttgattgaatcatgaattgctttcatttcgtatccgctttcccggaaatattttaataattgttccaaatacgccgcggtagttggcttttcatgcattaatacaataagcggctcttttccttcaagggttttgacttgctgaatgacactcttaacaaactctccatgagtgtacttccagtcctctgagtcaaccgtccaatcccacaggttaaaatgatcacgctccacaacatttctaaaagggccagtaatgtaaggctttgacccgtaaggtgctcttattaaatgcgtgttgactttggttgtttctttaatgtagtccaatgtattgttcatttctgcagcaaagctttcaggggatttatagatttcggaaacctggtgcgtcacgccgtgagacccaacagaatggccgttttccgccatttttctcacaatattaggatttcgctcgatatttggttttaacataaaaaacgttccctttgcattgtatttatgaagcaaatccataattttctctgaagcagcagggtttggtccgtcatcaaatgttaaataaacgaccttcccgatttcagcaggttttttttgttcttttttctgtgctgaatttttgtgtgtttctatatgcgcctgctcagaagcgtttgtactttcttttattggttcctgctttgggccggcaagtgccttccaggaaatgcatagtaacgttacacctagaataatcaatatcccaaaacctatttttcctatttgattcaacttacgatcccttcttggtgaatttgacactttttccaactcctcaattgtagatatcaaaactagttttctcgcgaacgagtcacataaattagaaggccaatgaaactttggagacaaagcccgataaaaatgatgctcttttaatatagatgagagttatcgcagaagtttgatcaatttgtaaacaaaatgtcaacaaatgaaggaatcattgttatgtaatatcttgcaggtataagaaaaaaccttatttctattcaatagaaataaggtttacttgaaggatatgatataagagcgatcgtcaaaaaatcgggctgatgagttttccatagaagtatactggttttgttcataaacaagcaggttgctgccatctggactccaatatatttctgatgggctggtgccgtggtatataggttctgcgtagaggacatttttcccttgcagctttcctgcataagtattgtccttgtcatataaagagtaagcgatcttctttcgatcattagatatggtaaaaacagctacattttcgagcagaacagagagctcactgtttctgaggtcgtattcgtataaggtttctccgatacctaaaaatacaaattggtcattgtttaaccaaacaggtttaccataggggctaatctgccgcttattttgaatagtgatgctgtcaccgctgatggtccccgtcataatgcggtattgttgcccttgtaacatggtaagcagcaaactgtgtccatcatctgaaatggaaactgccgtaagcgaatccttttcatcaacattcttcaatggatacgttttgagggttccggaatctatgttgaatacattgaccgcagtctggtcattttttgcagtgtcaatgacaagataacaaatgtatttgctattatttgaccatgaaatatcctgtacaaaggcatccttgttagaagaaaagctggctacttcctttttgtttctgttcgtcagtgatattagatttagtgttatcttatttgatgacatcgttaatccggcgatacttttcccgtcgggagacaacttaaggttggaagtattgcggtcaatgttctgcagagtttcaggtttttcaaaaggataggagacattctgaagatgctgcgctttaccttccgttgtgtcatttcctttgaaaaaaccaactacagagtttgatgaagaccagccaagcaactggtcagcttgagggaggcgatatatcttcttcacctgaaaggagcctgacttctgatcgtcatcaatctggctctcttccttgtttggaatgataatggtttcagatcgcttgcccatattatagctggatacaaaaatcaaggaaatcaataatatccctgacaatataataaaccgtttgttcttcatgatcatttctcaaccttcatgtaagctagttcaatggtgatgattgtatggttttcttcgtagaacatcttgattgttcctccatgtttttcgacaattgttttaactatgcttaaccccaaccctaaacttccttcttccgtcaccttttggtttattgaataaaaaggctgaaacacttttgtgtattggttgtcgtcatatggatcacttggatttttgaacataaaaagaacctgatctcccgcaactttagcctgaatcatgatttctgaatgagataaactgtatttgatcgcattgtccaaaagattaataaagagttggcgcactctattcttttgaccatacacatagagactgtcttctatctcataggtgatcttctttttatatcgttctgcacgaaatttcatagattcgcatacatctttcaaaatcgttcctgcatcaatcctatcgaattgttctttagaggtttctctagatacctcaagaagttttataaccaaattgtgcagacgccggctttcttcaacaatatgattcattcctttattaaaaaacgcctgatctgattcccctttttgttttatgatttcagcatagccttgaatagaagtcagaggtgttttcagttcatgggtcatattgtcaaaaaaacgtttttcctgttcattaagttcctttaacctgtcccgatctttttcgatagttgaaatttgatccctaattctggtgatcatatcattgaaattaaccgtaagctggccaatttcatcttttctagaaaaatggatatccacatccagctttccctttttgacttctgaggtggcctctgtcagcttgacgattggaatcgtgatgtgtctggagagtatataagagaaaagaaacgccgccacaaatatcgcaagagcgatataaaaaataatatttaaaatctctccgctttgtttgtaaagcaaattaaaatctttagaaaaacgcaatatgccaacttttgcaccatcaatgacaactggataagaaaaaaacacctgtgcttgatttcgatcataggtgatatgataagcattttttccgttaattgcttttgctaggtcatcgtcaatgccttgtgaaaacattgttttattagaagaagacaacaaagtgccatctacggtataaacgcctacattgctttctgttgaatgagttaaactatccactatttcatcggccatatcgccgaagtatagttcattgtttttataatgattgattaaaaatgcttgattgatatacacgatgctgtttttttttaactctattaaatctgaggttacaattttttcattgcttgaccaaatgacgcttttgaccgtttgattgagtactaggaaagagagagaaaaaatcagaaaaaaaccaataataaatttacccttgatcgtccgtaacactctctactcctcctgcttctcgaatttatatccaatgccaaacactgttttaatgaggtcgcttgcatccagttttttacggagtctttggatatgagtatctaccgtacgtgtatccccggcaaaatcgtagccccaaacaaattccaacagctctgaacgtgtaaagatttttccacgatggtcaatcaatgtcttaagcagatcaaattctttaggagtcaaatcaacaatgatcccatctttttttactattctttcgtctgggatcatcacaatattttttaattgaatgtgatcctcattagacgatcctcgatcattcacgtggttagcttgttcaagacgtctgagtattgtacgaattctggcgataacttcacgcaagtcaaatggctttgtaatataatcgtcagccccaaattccaacccaaggactttatcagtgatatctgactttgcggtgatcataagtatagggatattatagcgttgggtcacttttttacagatatccaatccgctgcaatctggcagcatccaatcaagcagcagaagatcgggtttgaattggtttagctgtttcatccctaaagctccgttagattcagtacacgtttgaaaaccttcctgcgtaagcccgtatgaaagcagatctgctattgcttcatcatcttcaataataagtattttcgttttatccattatttcattcattccctgtttcatgattaaattgaatatatctatcttagcgtctgcaatatcactcattatagcattctttttaatagtgattattcagaacttcagaccaaactataattggatatattttcaccatcgtcaacaaaatcgggggaattgagctatcgttggattagaggactatggtaaacaatgcaattttaattgataaatgagcttattaaaaagataccaaatgatgcgggtatcttctttatttatgtataagagcgtgtccatatcgtttgattttattgggtgttaaataggtaaaacataccccgccaactgtaaccactccgcctagcagagagatcagtgtgggtatttcgccgatccagatccaagatatgatcaaggctaaagccggtgtaacataaagtgaaagggttgcttctgaagcaccgacgagtgaagtgacatatgctagtgcgaagtaaggaataaccgtcggcaataatcctaagtaaacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagagtgcaaatcctaaaaaccctaaaagaaaaatggcaggaatgtctttcaagtcgggtaggcgcatctgagtcaaaacagcaaaaagcaataatgccatagagccgattaacaaacgacataaagcaaggtgttctggtgtgtacccttctagtcctgcgcgaattcccggaaaagcagatgcccataaaccaatcatgagactatgagatatcattatttgaactgttttctttcgcattcctctcactcctctttacaaaaaccaaccagttatttaatgtgtttttatattaataaagatttggtgatatagcttcaaccagttaaacggattttgacccaaccaatttattttaaggagaccgattctatgagctttccagaagaaaaaaagatgaaaaagctccctaagtacagacaaatcgttcattttattaaagagaaaataggaaatggagagtggccgattggaagcaagattccaagccagcgcacgcttgcaaaagattttcaggtaaatcggagcacagtgattacagccttagaggaattgatggccgatgggctaatagaaggcacaatggggaaaggcacagttgttatcaacaacacatggacactgatggctaagaattctgctcccgattgggatcgatatgtcacctctggtattcagatgccaagccgaaaaatcgttcaagagataaatcaatcagaatcaaatacagaccttatacagctcagtaaaggtgaactttcagctgagatttttcctttggctgttatgaaagagatgatggggaaggtatctcaacacatggaggcattcggatatgaagaaccaaaaggttacttacctttgagggaggcattgagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcgtggaagggctatcttatatacaaatccatgttttcacaatccgactggtattcttatgtctaaaaagcggcgggaagaaatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggcttgaggattggatggatcgtcggaccggaaccggtgattgagcgtttatctgacattaaaatgcaaacagattacggatccagttctttatcccaaagagtagcggcagagtggtttacttccggccaataccagcagcatgtagaaaaggttaggcagcaattaaaggtgagaagagaattggccttgagtgttttagaaactcatttgaaagatgtggcgacatggaatatcccaaaaggaggattttttgtctggataaaaatattgccttccatatcaatgaaattactttatactaaagccttatcaaaagggattctgatcaatctcggcagtatctatgctcaggaaaaagggaattatattcgcttatcatatgcttatgcatctcttgaagaccttcaaaaggggatttatgagttgggtttaatgataaaagaactggcaagtaagtaacttttatatccttaaatggatgtttcactaaaaaagagatcaagcctaatgatcgcttgatctgataataacaagggttactagaatagaccaaatcatggttcggtcttaaaatgatcatgtctctgaacgaaaagtctttccgacttctcttcctaaaccaaagtaatgtctgaaattatagataagcgggctccatttggaagggttgatatggttttcgtctagtataatactttcctcggcatgaaaatgtagtgcctgcgtctctacaattgcgaatgacgattcatattctggaaaccgaatgtgtttcacttcggcttctatttgaataggacattctttgattcgtgttggtgatactgtttttgattgtaaaggcgttaaccctgctgcctcgtatttttcttttttatatgtaaatccgagctgtttcttcaaaggcggtatactcttttttccgctataagatgaaattctttcaacgttttcccataattccgggccaggcaagtttatgacacattctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggttttatttctttaaatcgacgagtgtctcgttttttgatgtccaatgttttttcctccttgtcacgcttacatttatattgtaaaggattaacatttcaactatcatcgaaatatgaatgtaaggaggaaaatcatgaatcctaatattgcaaaaatctcttcgttgctatcagatccctcgcgttcttccattcttctcagtctgatggatggaaggatacaccctgcgggagagcttgcatatctcgctaacattaaacctcaaaccgcaagttttcacctgaataaattgcttgaagcaaagctgattagcgtagagaagcatgggagacatcggtattacagattgtctgactcagatgctgcaaatgtgatcgaacaattgcttcatattgcgcctaaagcaaaagtcaaatctttaaaagagtcaaaagagaaaaaggacttgcatttcgctcgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcttttgcccgctgctgtttggattggagtgaacggcagcatcatattgcaggagcattaggaaacgccctattggtgcgcatgttagaagaagaatggatcgttcgtatgcctaaaacgagagcgattaggattacacaaagcgggaaaatcgcgtttgaaaagcacctaaacgtgaagatttaggactttgaagcggaaacaccagatgatgaggcacgatatctaggaggagtaagatttgttctaatcttactccttcttcttattttgaagcagctcgattccccattgcaatagagatgcggttccaactgtttatttgattaatgatgagaacaaggtcaacatattgtttttcatcataatgttcccgcacccgatgatatagctcatcaggaacccttttagatggaatgagcgtgatgtgttcagatagttcgagagccgctttctcttcaggtgagtaaaaatcacattcattccaagcatgtaaacagtaaattcgctgttcagtttctcccattttgcgggcatcggacgtatgcatatctatgcagtaggcacagccgttcatttgagagactctgattttgattagttctctcgtcgttcggttaattgaggattgtttcgtgtatttctccatatccatcatgattttcataccttcaggtgcaatctcatagtaggacactctttgactcataaggcaagactcctttccatagaatacctagattgtatcccggtattgatcattttaccaatgtgcggtttgaatgacagctgtttcagcgtcttttggaaagaagcttctttgaataaaaataagggtagccagcaatgatgagtggagctgctaatgcaagcagtatccatgagcctgattggctgtctctagtgactctaatgaatatataagtaccgatcagaaaatataataaagcacctagaaaccaatacatgttcaatcctctttttccttactttttggttgcgcatttttgtctgtcatatggcttaatcgatcagggttctgattttttaataccttttcggtccggattccttttctctttaatgataaaattgtgagatcaatcgatttcaatgatgatcattccttcaatgaatagtaagttccttatgattttaaaggtaaatttgaaaagataaaacgtacatagaggcagaacgttcatgtacgtttgggcaatgatcacttgttggaaactctaatgtttccctgcacctgatattgttgtgttccttctcttcctataaaatgattggatacatgtgtgtttgcacgttgaaatatgagttcgattttcatgaatctctattcggtgaaacaggtaaaggaagtggataaggtttgcttataaggaatccttttaaagataaatattactcacatgataggcgggcattaaacatgcttgcactcagagtgccgggcctggcttttattctcatgatctatatagcctctatcgtgctgcaatttgtttctgggggctggtccattttattgctttatgcgtttaccatattaatcgccatttttgctttgcttcattggcactcatatcgctgggttaagaaaagggtggttctgtattttgtgatacaaggtttgatcacctttacacttgctaatctcatgactggctaccttatgctggtcatcattggcctttatgcatttttgattggacagattttaggaatggcagacagaagaaggacgattcccattctttatctattgctgctgctggtcataaattcggcgtatcaccttcataaaggtgaagttttgcattttattgttattgctgcgccgatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtgaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcatcaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgcgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgagttagaaccggatatcattctgatggatttgtatatgccggagatgagcgggttagaggccattaaacaaataaaagaaaaacacgatacccccaccattattttgactacatataatgaagatcacttaatgatcgaagggattgaattaggagcgaaaggatatctgttaaaggatacgagttcagaaaccctttttcacacaatggatgcagccatcagaggaaatgtgctattgcagcctgatatccttaaacgtctgcaagaaatccaatttgagcggatgaaaaagcagcgcagtgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttgaaaggagattatcatgtcaaaaatgttatatacattaggaggatgggttgctcgcaatcgcataaaagcaatatgtgcgtggatcgttgtgttagttgctgcgataggccttgcagtgaccttgaaaccaagtttttctgaggatatgtccatacctgacacaccttcggaaaaagcgatggatgtgattcaaaaagaatttcctcatggtcctgataaagggagcatacgggttattttcggtgctggtgatggggagaaacttactgggaagccagcaaaaaaagcaatagaagatacgttcaaagaaatcagtaaagatgattctgttgactcgattgcaagtccttttgtgacagggacaatcgcgaaagatggcacagttgcctatgctgatatcaagtataaatcatcagcagatgatgtaaaggattactctatcaaacacttaaaagacagtttgaaaatggctgatgatgaaggattgcaaactgagctgagcggagatgtaccgggagccgagatggagataggcggtgtctctgaaattgtcggcattatcttggcttttgtcgttttagccattacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttacgaaacaccgccagtttttaggcgaaggcatacaaaagaatgaatcaattgcgagagccgtgggaacagcgggaagcgcagtcgtttttgctggacttactgttatcgttgcactttgcggattgactgtcgttaacattccttttatgtccgcgatggggctgacagcagggcttagtgtactgatggctgttttggcttcaatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggtttagaccatgtagcaagtgtcacccctgcaatgcctaataaagaagggaactttgccatcattacggtcgttccggaaacaggtccaaatgatgtcacaacgaaagatttggtacacgatgtacgcagtttgtcagataaaaacggagtagatttgcttgttactggatcgactgcagtgaatattgacatttcagatcgcctgaatgatgcgataccggtgtttgctgtacttattgttggatttgcgtttgtattgctgaccatcgttttccgttcgctgcttgtgccgcttgttgctgttgcaggtttcatgttgacgatgacagccactcttgggatttgtgtatttgtcttgcaagacgggaatctcatcgactttttcaaaatacctgaaagagggccgatactcgcgttcctgccgattttatctattgggattctgttcgggttagccatggattatcaagtattccttgtcagcagaatgcgtgaagaatatgtaaaaacaaagaatccagtacaagccattcaggctggattaaaacacagtggtcctgttgttacagcagccggcttgatcatgatcttcgtttttgcaggatttatctttgcaggcgaagcttctattaaagccaacggattagcactttcctttggtgtgctctttgatgcctttattgtaagaatgacactgattccaagtgtcatgaagctgatggggaatgcagcctggtatttgccgaaatggttagacaagatgattccgaacgtggatatagaagggcatcaactgacaaaggaaatacagccggaaatagatcatgaacaaaagaaacaaatcagtgtgtaatagaaaaagcagatctttaatgatctgcttttttgcttactattcctgatcaagctgtaaacgattttatagccgaacattgtggtggtatttggaaagtgaagtcggtacttaaaaaggagacacttatggcgccatcactcattttcgatatggatggaactttgtttcatattggcggaagctgcgtcatactagcaggcatcccaggagaagtgataaagcatatcaaatgatttttttgacgctgccttctctccatgatgcctaggttcttgataattcttcttaagaataaaggattttacaactgattatataagaaacctaaagaaacaagcacacaaaaccagctgcgggttttgtccaagaaaaatagagtccataagagggactctattttttgaaatgcccggctagaagcatattgcaggactttatgaatgcaaatcactatcttataagcccttaccgtgaaatgcctgtttctgcattgaaaaaacgcattacacgttcatttacgtaagcgggttgttccatcgataaaacatgtccggcatttttaatgacttccgcctcaatatcaggaacgaatgaagaggctcggtgcagggctgagtggggatcatagatgacttcatgttcaccaagtaataataggataggaactcttgctgaacgtaattcctcatcggtaaaaacatacggaaatccgtcggctttaggatttggatttcttgatccatcctgccacattacccctgcctgaaactgcttcacaaaaatcgggtgcagcacattctgatcattcatcatccaatttaagaatttttcaactccatttgacgctgtaaggccaagagcgtatttgtagaaatcgtgatgaaatggcaaaaacgtttctgccggactcagtatagctgcgctttttactctctcaggcatacgtaaaaggaaattcatcgtatggagaccgccaagcgaaagtccgatcatgtgggacttttcgatccccagattgtcaaacacatcaagaagccaattggcgtaatccgttcttgtaccgcttaaattctcaggaatactcttgtttttatcacctatgatatcaactgcataagttctgtatttgctgctccaatcggcgatgttgggataccacatcgtcgagctgaataatgctccgtggagtaatacaagcggcggggcatcctctgggccgcttacaatcacatgtgtttgaccaaaacgagtagatatatagaatgatttgcaacggaccggccaaagactaaggctttcattataagtttgataatagcggataccgttgtcacttaattcgggaatactagatgaatggtttgacatacaaatgcccctcccaattttgtttaaatgaatgtgccgtttcgtgatggggaatctgattttgatataacagactttatttacaatataatacagttgttgttagacgtcaaatccaagatgaaaaggaaataaaacgattggaacagattattgaaaatcaatataacagaatattaacctcctttgtggagccgcttcattaaaaccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccttgccaggcaaataatacaatggctgcagccgctattccaaaaccaaaagttgaagcgagcacaatggaggtgatcccatctaacatcccgtttgtcaggaggtatgtataatctccatgcaaagcggcttcaacagggcccaatattgacagcgaacctatacaaaataataagaccgcagtagataagccctctgctaaattacttttagaaaatttgttcaccagcttgttgaatcgtaattctaaattgatgatctggcctagcaaacctccaatggctaaactcacgatgaatagaatgggatatttactatcaggcaaatgctgtgtaatggcgttgatccccagcgcgactgcagcgaatcccattgcctgcatcaaaatatcctggtattcatctttaatgccttttttgaatatcccccgattatgcttcctgcaatgatcatcactgtgttaaaaatcgttccaaacataagctttctcctccaaaaatcattcctgcataaaaaataaaccctctagttagtagagagtcaagggagatcaaaacatattcatgagattatttgatgggcagcaggatttcagtcacgtaattatctaggttattcgtaatgccataatcaatgagtgtgatttcgattgagtcccctgctacttcataatgatgttctttcatatatgccagtaattttttgtagtatggttcggcttctggatgtgaccctttaaacctaatttgcagatattctcttgaaggaaagatgatttctgaagaagttttttcattttcatcttcaagaatcataaatatactggaatatttgtcaaactgttttgctttcacatttgctgcagaaatggataaaccgatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttctttttgcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatttcatcataataccgaagagcagagattttcacattgaataactttgacacttctccaatcgaaaaaaattccttcattctaacaacctttctgtgcctatgattgatatacacacattatatagtacggcgagttctaaaggtaaagtttgcatcataaagaaaaagctccttctaaaaaggagcttttcactcttcgaaataaggatttacatggatgagcacttcttctacatctgaaaactgtcttttgatttcatttcgaatttcgcgggcaatatcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaattccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccattttttcctcctataaaactgcacaaaaaaataggagtgctctatatacgctctccgtatcctttcctgtgtaatcactttgtttatcataccaattcaatttcgagtgggtctatagcaacgttgtttcctgtttactaataaataaggtgacagaaaaaaagttggagctgtgctaaaagggtcatacagcaaacaaatgagttcttatgtaacaacagtgatgattcgccattaaaatgctgccgtcagtgaaaaatttccacctgattgttaaaaacctattgacatgagaagatctgtattttattattatctcatattcaagatattttaattcgagatatttgattgaaaagatcagcgatcaagcgcaactctaagtgttcaatcgttgtcagttcttttacacaatattcaatatgattttttataacataatatctcgaattcgagataaaagggagtgtatcgtaatggctgaatttacacatttagtcaatgaaagacgatctgcaaacaattttctttcaggtcatccaatcacaaaagaagatctcaatgagatgtttgaattggttgcattggcaccatcggcttttaatttgcagcatacaaaatatgtgacggttcttgaccaggacgtaaaggaaaagctgaagcaggccgcaaatggacaatataaagtgattagctcttctgcggttctcttagtattaggggataagcaggcatatcaacaagcggccgatatctatgaagggttaaaggtattggggatattaaataagcaagagtatgaccacatggtgcaagacaccgtttcgttttatgaaaacacgggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaacatagacgaccaatttgaggttgtcatgatgattacgattggaaaagaaaaaacagagagcagaagaccgcgcggctaccggaagcctgtgaatgagtttgttgagtatatgtaaaaggagcggataaaaatggctaaaaaaacgatgggaattcatcatattacggcgattgtcggtcaccctcaagagaacacagatttctacgcaggagtgcttgggcttcgtttggtcaagcaaactgtcaattttgatgacccaggtacgtatcatctttattttgggaatgaaggcgggaagccgggaacaatcattaccttctttccgtgggccggagcccgccaaggcgtcattggagacggtcaagttggcgtgacctcgtatgtcgtgccgaaaggggctatggcattttgggaaaagagactagaaaagttcaacgttccatacaccaaaatcgagcgctttggggaacaatatgtagaatttgatgatcctcatggactgcacttagaaatcgtggaaagagaagaaggagaggctaacacgtggactttcggagatgtaacgccctatgttgccattaaaggttttgggggtgcaaccctattatcagcgcagcctgacaaaaccgctgaccttttagaaaacatcatggggctggaacgagtcggcaaagaaggagacttcgttcgttatcgttccgccggtgatatcggaaatgtgattgaccttaagttaacgcctattggccgcgggcaaatgggggcgggaacggtgcatcacatcgcttggcgggctaacgatgatgaagatcagttagattggcaaagatatattgcttcccacggatatggtgtaactcctgttcgggatagaaactactttaatgccatttacttcagggaacatggggaaatcctgtttgaaatcgcaactgatcctccaggctttgcacatgatgaaacacaggatacaatgggcgaaaaactgatgctgcctgtacaatatgaaccgcatcgcacacaaattgaacaagggctgctgccgtttgaagtaagagagttagattgatttgacacataaaaaataaagaaacatatattcaattgatgattgctggatggtactgtcagcaaagaatcagatgaaatcaaagatgaggagagatacaaatggaagatgcaggactgttgcttattcgtataatgattggtgtagtgtttttgttttatggcacacaaaaattattcggctggtttggcggatacgggattaaaggaaccggacaatggttcgaatcaattggggtgaaaccaggaaacgttgcggccgctctatcaggtcttggggagttagtaagcggaattctatttattttaggcgtattcctcccgcttggagctgctatcataacgatcatcatgttaggtgctattgtaaaagtccatggagcgaaaggttttgcgaatggcgccggaggttttgaatataacctggtgctcattgcagtttccataggggttgcactcatcggttcaggagcttacgctttgcatttttaatacgaaagtatgtaagaacagttgctgcttgtcagtaactgttcttttattttgacattttcggcaagcttgcaggtactctgcaaagtaaaaaagcggatataataaatataaatcagtatagtgaatgatacgtattgatgagcttggttataaaagacagacctatttgaaggagtaaatggatgaaagagatgacagaattacattcattagattctatagataattttatcaaacagcacaaattcagttttatttatatatcaagacctgcctgtacagtatgtcacgcagtcctgccccagctcagaatagtattggatcagtttccaaacatcaaattggggcatatcaatgctgacgatgtagcagaggtcgccggcagattttcagttttcaccgttcctgtgcttcttttgttcattgatgggactgagtttctaagagaagcccgttttgttcattttgaacagcttgaacaaaagctgaaaagggtttatcgattatatgaaggcgaataaagaaataaggcaaaaaaaagaactcaaatgagttctttttttgcatcaatttattcttcactaggcgaagaagggttatcaacctgcccttgatcacttgtatcattatcacaacttgctgaaataataattgaattagaaggagagtaatctcctaatgtgaaattgacaccgtaatttttgctgttcgcagtatggctgttttgcaagttttgtccgatatctgtattggcgttttgtgtcattccatttatcgtgagatttgaaatgttgatttgagatcgcatgcttcaaaaactcctttcactcagaagtagctgtcataaaggacactggcagtctatttacttctatgatattgcgtttttatatctttgcatcaacataatggtaaaaataatagcgagtgaatgagtctcttttgaaggtgatcaacctatcagcagaaataaagccgcctgataaagaggcggcagatcgttatatgtcatctatgaatttgatgtatcgtttttcgtttgcctaaaggataagatggtcgtttttaatgatgagtaggagcctatagcagcgtagccataaaaccagcccataaatacgccagaaaagaggctgtgtcgatggcttatgaaaacagaaatgacaaggcctgttattaaggcaactgacggtacaaaagttttggggattttcaataatattttgaggatttgggttatcaatatgatgattggaacagctatcacagcatcccaaaagttcgtgtgaataattggaaaagccatacggcacctcatgaagtgttaatttcttatttttacgctaaaagcttggaaagcagtccttggaccgcatttgtaacatgtagggcttgattggcggagcttgtttggcttaaagcattggattcaaaaaccaaacctgtattattccctccggaaccatctgtctctttagaaacagagaaagggctgatggaaaatgcaaaaccgttattaaaaacgctgtttccggatatcgaatgaatataaactgggaatttcatcattcatctctcctctctgttatgactgtttatacaatatggtgtgtgagcagcaattgcttaaacaaaacggcaaaaacattcagtgagagacaaaaacctgcaaaattctccaagtgccttttgttaatgcagttttttagggatgttttttttattctttttgtcaatttcatcaaaaatattctgattgctagacaaatgggcttgtccgtccttattaatgaaattcgggtgaatgagtttttttagatccctgacagttaaaggtttggcgtcatcagttaattctattcctaattgcccgtttgcttctaatgtcgcaattttgacatcttgtatagccgtaacgccgtgaagccgtagctgcatttcaagctgatcagctgtaagtctcatcttcttcaggttttcgatatgaagctgaccgttttcaataacaatttttgcttttccggttaacatcttttcaatgaagttcgatctcatttggatccattccataacgatgagtgtgattgtgaaaattgccgccgcaattaatgttttgaagaggctgtactcgatgattggctgaacgataatagttccgatcgaaatcatgacaaccgtttgagttgaagtcatttgtgcgattgattttcttcctgaaattctcagcaagatgactccggctacaatgagaacaagagattcccaagtgaaattcatgctaccacctgaccaatgatgaattagatttgtcatgggattggctttccttccggccaatcgcaatttaatatatccgaaaggcagtcggttcattctgtcctgaaccgaacaatatttttggtatagatggatatattaagccaaacaatgatagcagcaggagttttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggcgattgctggtggattagcttacaatacttcaataaaaccgcacaatatggccatttcgtttagtatttttgtgttaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattgcgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacacaggcttccgatagagcttattatggacggagaaatcattgagaataatttaaagcagaatcgtttgacggaatcctggcttttggaggaattgcgaaaaagagacataaaggtgaaagagaccgtgtacgcagtgctgctgggtaatggggatatttatgtggatcagtataaagaccatatatcagtccctatggataaggaatgaaggaacaatcaatcttaaagccccttattgaacgcaatggtttcaatttgtcttgggtacgaaatgtgcagaagcccgtttaacagctgaatctgtaacaaatgagattcagtggcttcgggaagctgaatgattcgctcaatttctccgtaataccgttcacgcagcacttccatttcggcaggaaaaacaggcgtgatcgttcctttgatcagcagctgggttttagatagtaaacggatcgttaattcttcctcatatacaccgggcatttccacaatgataaaattatattcttcatcttgataaaagtcgtaaacaaatgtagaagcttcggaatcaaaaaaatgttccggggctttatatttgagcacatttgtccaaaagtcactttgtttatattcattcgtaatctcaagccactttcgaattttttcgaaatccatatgagattctccttaaatttgatttgcaataggcgcagaagggtttccgatttggtcttggtcactaacgtctgaatcaatatttccagtgttcaaaagtgaagacgtaggcgaaagatcccctaaggaaaagtttgctccaaaatatttgctgttcgcagtatggctgttgtgcacagtcgggccgacatctatatttccgttttgcgtgacgccgttgatcttaatatttgcgatgttaatttgatatggcatagacgaaacccctttaatctaaaattggcggtggtgcaatcggaggagcattaacgttggatgtatcagagttgccgatagatgtctgatcatttacatcaggatcgtttaagaagttttccataaccgattctgtaggtgaggtatcaccgaaagaagaattggtcccttgagatttttgattgttggtagggctgttataagcagcttcgcctattgtaattgaaccattgcccgaaatactgttgatcttcaaataatataggttgattactgtagacggcatcccatcacacccttccatctttctgtacagtacattatgcgccgctgcacccaattgttccttgcatttgcgggcaaaactctatctggccccggagtgatgtttgttagaaaaaaagaataaagtttatcacagcctgaatgtcaatctattcagaaaatacttatcagtgaatgaaaagccattgatataataaattgattcagttattcgaaatacataagaccctttaataaaggaagctggcaacaggatgagtttgaaatcattgacaatgaagctaatgccatgaaataatactcgtaagtaacattactcgtgagtattattttgggggtggtcctagttgaaaagtaaaggacgtaaaggagaagaaagccggaaacggttactcaaagttgccgctaatgaattttcggttcggggattccatgacgcgaaggtaagtgaaattgtgaaaaaagctgggttcacgcagccttcattttatctgtactttcaaagcaaagaagccatctttgccgagttaataaccgattttcactctcgagtcagaaagctgacagagtcacttcttctggaaaacggattaaacacggaggatgtgtcaaaacgggtactgctagctgtagagactgtttttcaatttttggctgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgattcatttttgttaaccggaatcaaagatccggcaagcctcgcagcagaggttgtgaatcttttaatatacgggatgcttccgaaagggaatgacgtaagatgatatctattattacgaaagtcagtttggcagtttttatgcttgcgggaggcatcataaaggtaagccgcgttccctttcaagttgagcattggcggcattatcaatatccattatggtttctgactgttactggcattcttgaaatagccggggcacttgctatgacagcgggaatttggaatcggtatgcagcaattggagcaggtgttctgtttgtcgttctcatggcgggagcaattcatgcgcatatgtttcgagcaagacaatcggtcatcatggcgataccagcgatgatttgtttgattgtttctatcatgatcatcctggggagttacacgtaagcttttcactaatgtttaagaacaagcccatttgcaggaaatctccttttcttatcgaataatagaaagtccaggaattaactgaatcagtaaaatagagctccatttctgcgttattcgtccggcatcagctgggctttttttataaaggaggaatacaggatggcattaactttggaagacatgactgaggaagagttcgaagcctttcgagggatgtccgtgcaaaattatgcgaaacaaaacataacgtcaggaacttggacggaaaaagaggcgcttgagaaatcagagcaggcatatgagaacatgattccgaatgggcgagacagcagcaatcattatttttggaacatcaccactgaacaaggggaaaggatgggctggctttggctgtacgccgatccgctccatccgcaaaaggaagcgtttatctattcctttggattgtatgaagcctttcgcggaaaaggacttgctcaattggcgcttcaaacgcttgatgaaagagcaagagagcttggtgtggaaaggctggctcttcatgtatttgcacacaacgagacagccgtctatctctatcagaagatgggttatgccatgaccaatatacgtatgcggaaacagctatagtgaaaagccgcttacgttacccaaatacaacatgcctatctggaagcggtggcaggatactataagtcatcattagaaacattaatgtcatgagaaggcttgaacatataaagaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagttttcccagcacttcttgtctttctgtctcaagctttaatcgaagctcttcccgctcatttctttcagaaggagcggcgtcatttaactgcttttcgatgccgttgtttgagatgacgagtttactgtttgttgttttttcgagaaagtatcggtcatgtgaaaccgccagcaatgtgccgctgtattgtgacagtgtttcttccagctgttcgcgtgaaggcaggtcgagatggtttgtcggctcatctaaaatcagcacgtctttttcctccagaatatatgccatcagcttgatctttacacgctcacccatactcatatgcttgatcggttcagtccattgggcagctgtaaaacctaagtgtctcatcagattttgaacgtgccctcttgctttaaatgtttcattctcaaataactcttccggtgtttgttctaaaggcaaatcaaacacctcctgcgttaaatagccgatgtttgcagacggcgacacccatacacttccttctgctgtttcctgtcccagaatgatgttcagtaatgtcgtttttccgctgccattggggcctatgatcgcaaccttttcgccgtgctgaatcgtaaagtttgcgtttttaaagagggtcctttctccaaacgcttttgttacattctgaacttctaaaaaacgttttcctgttttgtgggttgtatcgattgaaaagcggactgtatattctggggttacgggttccgcctttgctttttccagctctttttcaagccgcttctgcttggatttaatctgggcatccgtacgcttcgcttttaccctgtgatattctttaaacccttcctttttcgtcgattgggcgtgggctttttccgaccaagaagcgagcccattcatttgtgcttcaatccgttcaaccattttttgctgcttttcatattcacgctgctgggtgagtcttttcttctcccggaacttcatatacccggagtaattccctttgaattcaatcagcgtctggtcctcaagcgaccatatttttgttgcggcttcgtctaaaaaatatcgatcgtgagaaacgagaatcacagtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctgatccgcaaaggaatacgccgcggtttcctgttcaaccaaagccagttttatatccttccgaaggatttgaccctgtgcaggggctaagtcattgtgaatgaggtgcagcagcgtagatttcccagcgccgttttttccgataatcccaatgatatctccttgctgaacactggcgtttacatgtttaaaaacagttagatcctttacttcatagctaacgtttgttaatgttacgatctctttcatccatatccctcgctttaaagggagaataaaaaaatcctcccaaatgtgttggaaggattagctgcgcctgtgcatgatcaaataagctattttttataaatagccggtgtcgtatatatagaaaatgggcagactaatcctattttttgatttgaaatattgatttcaaacggtaaaaataagattagttaatcattgtccacccatcatcccttcttgttttgattacaaacactatagcataccttcaaattcaaaagcaaaggtcatttttatcaaaaaaactcctgctctcatttttgaggcaggagtttcgagtgttattgatgcttcgcttttctcactttataaatcacaatcagcaaaataaaccaaaccggtgtgacaaataaggaaacacgagtatcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaattccccaaatgtagataaagcatacggttgaaatacttgtgatcagggtgaatacgccttctggcatgatgtagtttaacgtaacaccgattaaaatcacgatagctgaaaagaataaagcatttctaggcactttacgctgagtcagtttcgccattgactcaggcgcattgtgatctttcgccagggaatagaccatacggcttgtactgaatacagcgctgttgcacgctgaagcagcggatgtcaacacaacaaagttgataatacttgcagccccgacgatgccaacagcgacaaatacttgtacgaatgggctttcgctgggattgatgacatcccaaggatagatgctcataatcacgagaagagccccgatataaaaaagcagcacacggacaggaatattgttgatcgccttagggattactttttcagggttttctgtttcaccggccgtaagcccgacaagctcaatgccgacaaaagcaaacacaaccatctggaacgagaggataaacccgtgcatgccattcgggaacaggcctccgtgactccagaggtttgtgaagctggacactcctgagcttgtggaaaagcctttgaaaatcatcacaaggcctatgacgattaacgccaaaatggcaatgactttaatcaaagcaaaccaaaattctaattctccaaaaagcttgactgtcgccagattcataatcagtaaaataataagagcgattaagccaggcacccattgcggcacacctgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaagaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgctttcttatgctttttcagttttttcataaacaggtagagcccgtaatctgtcggtgcggatgcgtagcctgcctgccgcagcattgctgtgatattgccgcggtggtatgtcccgtgattgacaacgtggggaagtagttcggaaacagttgatttcatgattccgcttgagggattttgaatctggagtggcttattgagctgttctttttgctgtaaaaatagtgtaaagcgctcggataacctcagaaaaaggtcttccatttcctctatttcttttgcctctgtctgttctttaagctgttcagctaaagccaacgcatcgctcaaggttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaacgccaaatctgacatgttaaaattccccctttcatgtgtatagcttctattatacacgaacgtgcgttctcgtgtagagtgcccgtgaataaaatttgttgacatatatagtttagaggaataaactaattgacattgaacataaagtttagcggggtaaactataatgaggaggggaagatattgaatgaacaaaagctatgtcaggcgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacctctcccggcagcctggccatgtaccaaaatgtacataagagcgcgatctctaacagactgaaaaagctgctcgaaaagggattggttcaatgggacgacggtccggaaaaaagtgataggcgctctaagcttattaacattacacccagtggtgaacacatactagaagaattagattctgccatctttaacgcgctcaaaccgttgattgatgatatagatgaggaacacttacattccatcatcgagatattcaccattttaaaaagcaaatttaaaggaggagattctgccgaatgagagcaatcatcaaattcaagtgggcaattgcagctatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagacaataattcgatcagtgttgtctttacattagacaacgctataaagaaagaaacagagaatcagctccggataatgattgataaaatcaaaaagatcgacggtgtagaagaggtaacatctcctctgtcagcggaaaaagaagtcaaagaccagttgatgtcgaaagacaagaaaaccgttctcatgcctatcacgattacaggttctgataaaaaggcggaaaaaattgcggacgagatttatcaaatcgttcctgatgacttgacggcatatattacgggagcttcccttatcaaccaggatttcgctcacagctcagaggaagggcttaagaaaacggaagtgatcacagtctgcctgatcatcggtttactgttgatcgtgttccgatctgttgtgacgccttttatcccgattgtggttgtcggtttttcttatctgatcagtcaatccatactgggcatccttgtatacaatgttgattttcctatctcgacgtttacgcaaaccttcttagtcgcgatcttgttcggcattggaacagattactgcatactgcttcttacacgattccgtgaagaattggcaaacgggcatgataaaaaagaagcggcgcttatcgcttaccgcacagggggaaaaaccttatttatcagcggatttgcggtattgatcggattttccgccttaggatttgcgaagtttgcgattttccaatccgcagtaggggtagcagtcggtgtgggaattttaatgatcatcctctacacactgctgccattatttatggtgacgctgggagaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttaatcatgttgactctgttatgaccattacgcagccgactggtaaaaaaatcaaagatttatatattgataaccagctaggatcggtttcagacgggctggataagacggtgaaagggattgccgatgtccaaagcggattaacggatatagaaaacggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaataagcggacagcttggccagattcaaaccggccttgaacaagcgaaccaacagctctcaggccagcaggcacaagccggaacgctgacagaaagcctaaaaaagctgtccgaaggcgtgaaaagcgcaaatgagggcctgacgaaagtctctgacggtattacagcttccagtgatatattagaggacatgagcaaaagtccaactgtaagagatactggcatattcattcctgatcaagtaatgaaggacaaagactttaagaagtcaattgaccagtattcctttgcagacggcaaaggtgttcaattaagtgtcgttctggattcaaatccgtactcagaacaagctattacgacaataaaccaaatcaaaaaagctgtcgcaaacgaagttgacggcactcctttggaggatgcacagatcgtatacggcggggtcacgagtatgaatgcggacttaaaggagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgtcaatacactgatgcaggtggcaagtgttatcatcatcgggctcttgctttacggccttgtcattcttccgctcttcatcccggcaatcattgcgacctttggagaaggaaactggtggccgttcggcaggaagaaaggaaaagaataatcgagagaagagtgatgaatggtcatcactcttttttcatgactaaacgactaacttcagacgtgttaccaaaaaagatcagacgatcaaacggcggctgtacttaaaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacgagacctccgtcaatcaggatcgtttcacggttgacctgtgccggaagcttttcaaaatgtgcggtcagcgcggcgatttgtctgtctttgacctcctgcggcatgtaaccaagttccacggcttttgaatagatttcttctaggtagtctgcattgttcatgtctgcaaatacagcgatgacagcagatgatgttgtgacctgtgtttggttaaagcttgcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcggatagaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttagcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcacttttgaacaacctcccagcgcataaaattcgctaggctagaacttagcaaaaaaagctggccgtttcttcagatgatgctgatcacgatgattccccgcatcattccctttataggtgttctgaatatcactttgcctagcccgtgctcaagcggctttcacaggctgaaagttatgatacaatatacaaatgtttcacagcttcaatccatagttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcggacttacgatcggccagctgattgtcgggccggtcagcgatgcgcagggaagacgaaaaccgctattaatctgtatttttttatttgcgttatcttctctgttttgtgcactgtcacccaatataacaactttagtggctgcgcgttttttacagggcttcactgcttctgcagggcttgtgctgtctcgcgcaatcgtccgcgatgtgtttaccggaagagagctttctaaatttttctcgctgttaatggtcattaccgcggtggcgccaatggttgcgcctatgacaggcggtgccattttgcttttgccgttcgcaacgtggcatacaatttttcacgtcttaatgatcatcggatttttactagttcttctgattgcattgaggttaaaagaaacgcttccgccggaaaaacggattccaagctcaatcggaacatccgtcaaaacgatgggcagcctgctgaaggatcgatcctttatggggtacgcgttaactgtcggatttattcacggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccctagccatggaaaagcaggggcaccgcgccggaagtgcaagtgcgctgcttgggatgctcccgctgctccttggttcaatcgtgtcaccgcttgtaggcattaatgagacaacagccgttccgatgggagccatcatgtttgtaacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggcaccgcacattgtcccgaccagaactttgacaagcaaaacgtaatcaacaaaaccttctgtgatatacccgatgcctccacctacagccagagggatgatcacaagcatcgtcgttccgacagaatggcgaatggacagattcagcataatcattaaaccaatttgaataaaaggtgccgacccaatgccgaatgtgccggaaagaacgccggctgcaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagatgtcagcttggcgccgaaaaatgagccaaccgcagcaaagcctccgactattaagccgattttcatttgaatgtttccctcgcgatagtggctgtatgcccctgataagcttgtaaaagccatgccggcaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaatgtaatcgtgcgctattctggcggaggtatgatgtcctattgacgaagaaaaacacgccgttttttcagttgccagtagtccgtcgaccgtcgttcagcaaacatatcgtacctcaaattcagggatctgacaaggcagtttgttgcttcccattaccatctgttatatgattttgatgaagaaaagcccttgaatatattcaaaagaggtattatatatggacgattttaaattagataagccgactccctactacctgcaattttataaccagctaaaaaaaatgatcttcaacgggacttttaagcctggggaacggataaacgaaacacagctggcgaaaagctttggcgtcagccgctctccgataagggaagccatgcgattgcttgagaaagatggtttgttaaaagcggatgaccgaaatggattttcgatcacgtcattaacggcaaaagatgtagatgagatttataaaatcagaattccgctggagcagctggcagtcgaattagtcatagacgaagcggacgaagaagagctgaccatactcgaaaaacagcttgaagaaacagagaaagcgattcacaacggcacggaagatacggaaatcattcgtttaaaccaaaaatttcatgggctgctggttgatttcagccataacagacatttgaaaaatttgcttgagcatataaatgatctgattcatttttgcagaatccttaattataccggcgaccaccgtgcagaaacgatactgcgtgagcaccgcaggatatttgaagaagtgaaaaagaaaaacaaagaagcagccaaacagcatgtgctggctcatttcaatcatgactgtgagcatttgaagcatgtgcttgaagaaggaaaagagaattgatttgtatgatccggtaccaagggggagcagaacccttggtatttttttatgtattcaccacatatctaagaggccccgttaataagattttatgatggattgactaacgaataatgggggttaaacatgtttatccatatcgtcgggcctggtgattctttgttttccataggcagaagatacggtgcttctgttgatcaaatacggggtgtgaatggtttagaagagacaaatatcgtgccggggcaggctctgcttatccctctttatgtatatacggttcagccgggagacacgctgaccgccattgcgacaaaagcatttgttcccttagagcggctgcgggccgcaaacccgggcatcagcccaaatgctttacaagcgggagcaaaaataacgattccttcgatctcaaattacattgcgggaacgttaagtttttatgtgcttcgtaacccagacctcgatcgggaattaatcaatgattatgcgccatactcgtcttcgatttcgattttcgaataccatattgcaccgaacggcgacattgcaaaccaattgaatgatgcggccgctattgagacaacttggcaaaggcgagtcacgccgctggcaacaataacgaaccttacatcaggaggcttcagtacggagattgttcaccaagtactgaacaatccaacagcgagaaccaatctggtcaacaacatttataacttagtttccacaaggggatatgggggtgtcacaatcgattttgagcaggtgagcgccgcggatcgcgatcttttcactgggtttttacgccagctgagagatcgacttcaggcgggagggtatgtgctgacgatagccgttcctgcaaaaacaagcgataatattccctggctgagaggctacgattacggggggataggagcggttgtcaattatatgtttatcatggcttatgattggcatcatgccggaagtgagccgggtcctgtagcgccgattactgaaataaggagaaccattgagtttacgattgcgcaggtgccgagcagaaaaatcattatcggagtcccgctctacgggtacgactggatcatcccgtaccagccgggcacagttgcttcagcgatttcaaatcaaaacgcaatcgaaagagcgatgaggtaccaagccccgatacaatattcagccgaatatcaatcaccgtttttccggtacagtgatcagcaggggcggacgcatgaggtatggtttgaggatgtcaggagcatgagccggaagatgcagatcgtccgcgaatacagattgcaggctattggcgcttggcagttaacgctgggctttacaccgggcccatggcttctgcggaaattttttacgattagaaaagtgtaaaaaaagacaccagagcttgggtgtcttttttttgattaagtccagagcagcagaatagttcattcatttgtaccttgcatgggttgtgttcccattttacgattagtagtagtctgattaaacaaagagtcagaatacgatttgagagggagttgtctacatgaagacagtattgattttgaattttcctgcggaaggccatgtgaatcctaccttaggcattacaaaagcgttttccgataagggatatgatgtccattatatatccactgaaaaatataaagaacgattagaagcagcgggagcaacggtccatcttcaccgggatctgctgcgaacgacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtaagggattacttagatattccaggagtctcttcatcggcgtctttcttgtttggcgaggagcacctgaaaatcctgccgctgcatccggagtctggagcgccgcttgaattggatcaagagtgcgaagaccttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctatttatcgggccgagctttccaaagagagcggaaaaaacagatttcccgattgaacagctaaaagatgagaaggtcatttatatttcaatggggactgtactggatcatacagaggattttttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggttgtcatgcctcatgacaaggatcagccgatggtggcgcagcgtctctctgaactccatgcaggctatgtcatctctaaagatgaagtcaatgcccaaatattaaaacaagccgtagatgaggttttgcgcaacgatcagtatatggcaggcattaaaaaaatcaatcaaagcttcaaagaatgtatggacatggaagaagtgatggagcggattgatgagttgattcgccaaaaaaacaaataagaaaaagaactcccgtaccttgtacgggagttcttaatttaaaacttaattttgattttttgagcatcactgattttcttatggttatggtcaaagacgtcacttgtcgtgatttcgatccacttgatctcttttgttttcttctcagcatccgcggccttatcatgagcatggccgcttgatgcgttcacaataaagccgagatttccggacttttcggcgccaccttccaattcgccgtttaactcttcaagataaatatctttgttccaatcaaaggtttcgcccgtatttgttttcatcaatgcaatcggcgcaacatttactttttttgaagaggtgttcttgatatcaacgaagaccttaacgaaatcaaactcttcatcgtgtgttaactcatgaaagtaatcaatcatgctgtagtccgggcgcaagtggatcagcttcatttcttttaccgttaactccacgtcgccaatcttataggttttgttcacttgtttgatatcttttaagacagcttttcctttatcatctgaaaacgtttggccgaccttaagcaatgaccggtcatcagttacctgggaattaggctgataatcatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaagacattttttgcgatttctgtattatcaatttggccggcaaatgtctcactagacggaccgtatgcatagacgggaacatcttcaccggtatgtccgcctgttgtccatccagtgtgagagcgtttattaaagatgttctcgattgcgttatcgatatccagtacttccttcgattttgccgcttcttcaacagattgaatttcggcttttgttaaagccaattttttttgatcgatatatgttttcaacgttttttcaacatccgcgccgtcagcgatcttttctgccataaagtctggtgtgcgctttgcggctttaatgggttcactgaaccagttgtagatgccgtccgcaccgatggaatatccgccggttgaatggtcagccgttgcgacaaccaatgtgtgcttgtcttttttagcgaaatcaatagccgccttataagcttgttcaaagtcttccatctcgctcatggcgccgacgatatcattgtcatggcccgcccagtcaatttggctgccttccaccatgaggaagaatccgtctttatccttgtttaattttttaatggctgtgtttgtcatatctttaagtgatggaatatccttcgtccggtcaatctttttaggcaggccgccgtcagcgaataggccgagaacttggctgtctttgtttttcagcatgtccttgcggttatccacgtagctgtatcccgcttttttgaattccttgatcaaattacggtccttacggtcaaaattgctctttcctccgcctagaaggacatcaattttgtgcttgccgttgaccatctcatcaaaataatcatccgcaattgagttcatattttttcggctgtggtcgtgtgaaccgaaagaggccggagtggcgtgtgtaatttctgaagtagccacaagtcctgttgcttttcctttttctttcgcagcttcaagcaccgttttggcttctgacccgtcgttatccacggctatggcattattgtatgttttaattcccgcagacatagccgttgccgccgctgcagaatctgttacattttgttcaggatcatcggggtaagttgtttgctggccgacaagatactgatcaaaagccgtaggctccacaacttttgtctttttattatcctttaagtatcgataagcggacgtataagacacacccataccatcaccaatcagaacaataacattcttaatttcgtcttggtttccctttttcttttcctgggcgctggcatcaggcacactgccgctggctaagctgctgaacgcaattgatgataaaaccgcgataggcagtaatttcttcgggaattttttcaactggataacctcctaaatatagatgaatcactatgacaacccaattatatttttaaactgttaagctagtattaatcgattttaaagattggatttacaagaataatgaactgctatcaaaagaaggaaagagtgatagtactaaagaaataaattggaggaatagatactggccgtggatagtcggactgaaatctgctatagtcgcatagaagcaacccgcttacatcttgaacaattttaagtattatgttggaaagaggtattgtgtaagcacatgtctgagcaattcatatggagtggcatcattttattttaggagggaacaacatggacgttttttctgagtacttagcggggattgatgacccgttccaccgagaaagaacggaagaggtgttaacttggatcaaagataaatatccaaatttacatacagaaataaaatggaatcaaccgatgtttacggatcacggtacatttattattggctttagtgtttctaaaaagcatttagctgtcgctcctgaaaaagtaacgatagcgcacgtagaggatgatattgtgaaggccggatatgattacaccgagcagctgatacgtatcccttggaatggtccagttgattacacgctacttgagaaaatgattgagtttaatattttggataaggcggactgctccactttttggcggaaatgaagaaaaaggcataacatatgggctgtataaaatatgttatgccttttcatttgtctatttttcgttttgatcatctattgctgcttttcatcaaacaaggtcttttcattgagcgcaagctgactcgcagaataatgattaccttgtttccatttcacttcaatcgtaatatcatggccttcaagctcatgttcatctaaccgctctaaaaaagaaacggacttttcctttgcgcttccatcagaaaaagtgcctccagcataatcatgcatcaggatttccgtgtcagaactcagcagaacttcatcatccttttttacaatcagtgattccaaataagtgttgtctatttcaattgtatcaccgatccaataaagtttgccgctgtattcattcggtgcatcttcattttttgtgaaaacagcttcccaattctgatctttgctttctccctgccaattcggatactccaaacgaacatgatgaatcaggtgataggaaaaaaagatcaagcagaaagcgattaataggaatgccgtgaaaatgagagggtatttataatgactggacataaaagactcctattcgtttaatcaattaccttcgaaaatagaatttcatcccgaatcaaaatgccgttttcagccacctcgggaatctctggcttgagtcggcgcgctttttcaactgcgtttggaaacactgcggcgaattgatagcctctcttttgataaaacgccatcgcatgtacattatcattcgttgtgataagctttattcgttgacaatgtgcatatttagccgtctcttcaacctgctgaagtaaagctgtgccgattcctttattttcaatcatactatctaatgaaataatttcacaatctttcccatctattgtgtatgtaatacagccaatgatttcgccgctttcatttactgcggcaaatccatctaattcatcacaccgaaaaatgccgctggaaatcgccatctcgggtgtaccccaatgcttggcaaaaaaatcggtcaacatatgttttgctatctcattgtttgggatgatgatcatcgtaacactcctctattgaaagattgcatgtgtactatcaatataaacaatatataacaaaaaaatagacattgaggtgacagcatggaaatcagcgatgttatttacgggcaccaccatatagacggagtgctggaagagcttatcaaaagcgctcctgtgcaaaggttaaaagggatctatcaaggcggagcaagctttttagtgaatcgaaagtggaacgtgaccaggtatgagcactccatcggcgtgatgctcctcatcaaaaagctcggaggaacgatagaagaacagattgcaggtctgctccacgacgtatcacacacagctttttctcatgtggtcgacgttgtctttgaaaatcaagcagaagactatcatgaaaacatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattaacctgcacgaagcgcaaacctttttggatcatcttattgtgagaaacggaaggatgtttcctgatagtattgaagccgccgaatggtttgtcagtgtgtactacaaggaagtaattgatttctttttgaatcccgtgaatgtatatggatatgaatatttagcgcgagcattgaaggcagcgttgcggcatgatgtcatatccgcagaggatctgctgaaaacggaccaagaggtactgaacatcctgcgtgcatcaaaaaatgaagaagtcctgagcttgcttacatccattcatcccggcatacaagtaatagaagatgacatccagtacgatttccatcaaaagaagaaaatgcgcctaatcgatccatccatttttcttgatgacaaatggatcaaatcctcagatgtttctgaaaaggtgaggaaaatgggtgaggccgcttatcaaaaagcaaaaaaaggtgtgtatattaaaatcttaaatcagtaattgccgcctgacagcggcttttttcatgtttggctttgcaaacaaaggggaataggacaaactgcgggaacgctttatgagaatatcagcgtatttacataccgttcggggtatagtattatcgagagggcatgttttcattgtctgcgggcaaaagttacagtaaaaaaatgaagcaaaggagaatgaacatgaaaatctctaaaaatgcactgggaattctgatgttatctcttgtttttgttttatcagcatgcggcaataacaacagtacgaaagaaagcacacatgacaatcattcagactcctcatcacatgaagagatggaccattccggatcagctgacgttccagagggattacaggaatctaaaaatccgaaatacaaagtaggcagccaggtaatcatcaatacttcccatatgaaaggcatgaaaggtgctgaagctacggtaacaggcgcctatgatacaacggcgtatgtggtttcttatactccgactaatgggggacagcgtgtggatcatcacaaatgggtgatccaagaagaaatcaaagatgccggagataaaacgttacaacccggagatcaggtgattttagaggcttctcatatgaaaggcatgaaaggagcaacagccgagatcgattccgcggaaaaaacaactgtatacatggttgattatacatcgacaacaagcggcgaaaaagtgaaaaaccacaaatgggtcaccgaagatgagctttcagctaaataataaaaaatcctccttttacaaggaggatttttttgctgtttgaacaggtcttgttaaagaaatgaaagcaaacaggacagcgatgatcacaatcgatccgccgcaccatgctgttgacaccacagtacccgtctgatccaaaacaacaccgccaatggctgagccaagggcaattccgacttggagggccgatgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagcggcagtaagaacataatgatggcaaaggaaccggtcaccagcaaaatgctcttaaaggaaccaagccggtcagatagcgctcctccgaaagggcctccgcatacagcagatatcccgaaaaggaaataacaaatgctgacccagaaagagctcaggtgaagagtctcttctaaaaacggcgcaaagtaagcgtaaagcgtgtagtggccagctaatgtaaacatcgtgacgaggtgtgaactcgcgattttcagattaccgatcgtcttgagttgttcccggaaaggaatcattttctccgccggtattctttcaaagaagattgaaataatcagcatggagatcagtgccaacaggccgatgccaaggaacaaaatccgccacccgaaggaatcgctgattaagattccgagcggcacgcctaatgcgatagcagagctgaatcccataaaaataattccgattgcgcgggctctgtattcaggcgctacaattttcggggcaattgttaaagaaagcacaacaatcagccctgtactcattgctgccaataccctagataccatcagtgttgcgaaattagggctgaaataggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaattcccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaaatgatgaaccggacaagcgtatgattatatttattttataaaagtatagacatttaaaaataaatgactataataatcggtgtaagcgttttaatcacaagggggaatagcagttgaaaaaaatattactcgcgtgcagttcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaatttaacagacgaacaaatcagttttcagcttatcctgcacagcggcaatgcccgcagctgcatcatacaatcactgcgcgcctacaaagaaggaaacaaggatgaggcggatgctctcattgccaaggctgagcaggatttatccgcggcccatgacattcactttcaaatgatacagaaggaatccggcggagaagcacaagctttctcattgctgctcatgcatgcggaggatcacctgatgtcaacattatccatgaaagaattagtgaaagagatgcttgatatttttaaaaccaagaatctataaataatcggggtggatagggtgttcgagaaaatcagccaattccttgttccaattgcagggaggttaaacaataaccgttatttgcaagtgctgcgtgatgcatttatgctggctttcccgcttacgatattcgggtccatttttgtcgtgttaacgaatttgccgtttctaaacaaaatcatgaatgcctcaatgcttacatcgtttcagtctcatttcggcattgcctccacggcgactatgggcattatgtctgtctttgttgtgttcgggataggctattacctgtcaaaaagctatcaggtcgaagctgtatttggcggagcgatcgctttggtttcctttttgctcttaacgccatttatcgttcagccggaaacaggagatgccgttacaggggttattccggtcgaccgtctcggtgcaaaagggatgtttcttgggatgattacggcatttctttctggcgaaatctacagaagaatcgttcaaaaaaacctgacaatcaaaatgccagctggcgttccgcctgctgtagcaaaatcatttgccgcacttattccggcttttatcacattgaccgtatttttgctgattaacataatggtgactctgttttttaaaacaaatatgcacgacgtcatttatcacgcgattcaggctccgcttgtcggacttggaagcggtatcattccaacgctgattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggcctcgctcccggtatttttaacgtaaacgaaccgattatcttcgggcttccgattgtcatgaatccgatcattattgtgccttgggtgctggcaccgatggttgttacgctcgtcacctatctggctatgtcagccgggctcgttccgcctccgactggtgtgacagtgccgtggacggttccattattcattaatggcatcatggcgacgaactcaatcatggggggcgtgatgcagcttatcaatctgctgattgtcttcgtgatctggtttccgttcctaaaagcaatggataaattaaatctggcaaaagaaaaagaacaggctgtgcaggagacagctgctcagcaaaatgataacagcataaaaatgtgacataaggggagagagacttggcacaaacagaacaatatcgttttccaaaggatttttggtggggatcatcggcttcagcaacacaaacggagggtgccgccgacagagacggaaaaggccagaatatatgggattattggtttgaaaaagaaccgcatcgtttttttgatcatgtcggccccgcagacacatcccaattttacgacaactataaagaagatatcaggctgatgaaggagcttggccacaactcgttccggatgtcgatttcctggtcacgtttaataccaaacggaacgggcgagatcaacgatacagccgcagatttctataacaatgtcattgatgagttgatcgctaacggaattgaaccttttgtcaatttgtttcatttcgatatgccgatggcgcttcaaaaaatcggcggctgggtcaatagagagacggttgacgcgtatgaaaactatgcaagaacttgcttccgtttgtttggcggccgggtgaaaaaatggtttacgcataatgaaccaatcgttcccgtggaaggcggatacctatatgattttcattacccaaacaaggtcgactttaaagaggccgtccaggttggatttcatacgatgctatcaagtgcccgcgccattcaggcttacagggagatgaagcaggacggaaaaatcggcatcatcttaaatttgaccccttcatacccgagaagcagccatccggcggatgtgaaagccgggaaaatcgcagacgcgttttttaacagatcttttttagacccatctgtcaaaggcgaatttcccaaagagctggttgacattttgaagcatgaaggctttatgccagattacaacgctgaagatcttgacatcatcaaaaagaacacggttgacctgttgggagtgaattattaccagccgagacgtgtgaaagcgaaagaacatcttccgaatcccgacgctccttttttaccggacaggtattttgatccctacgtcatgccgggccgcaaaatgaatccgcatcgcggctgggagatctatgaaaaaggcgtttatgatattttgatcaatttaaaagaaaactacggcaacatcgagtgttttatctctgaaaacggcatgggggttgaaggtgaagagcgcttcagggatgaacaaggcatcattcaagatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatctcgagaaagacggagaaagaaccgtcaaaaagagcggaaattggttcaaaaaggttgctgagcaacacggtttctagattttcctaaaggtcaagatcttccggcaatcatcataacgaatagagatgacgaaaatccgcaacattgatgaaatagggaaaagaacttatgatatccgtaaaagcttatgtgatatcaaactctaacagctgccggaggataccaatgaataaatatgaaatcattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgtttagaaaacgaggccatggcacgtttattattcaatctgcaatacaggatgaccatgtccatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcgaattgtagaaggtgaaccctatgtattagaaaaaacatatatgccgactcatttaataccgggcattaatgacgatgtccttcatgattcgatctacaatcatattacaaatgtgctgcagctcaaaatcgccggaacgcatcggaaaatcagagcctgcaaatctgatcatattgaccagcagcatctgggctgtaaacaggatgatccaattcttgaagtggaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtaaagaagatggaacaatcattgaccgaatagaattccccacaaagatgccggatgaaacgatagagaaagtaattcaatattttcgccaattttcattacaggcaatcggcatcggttcctttggtcccattgataacgataaaaccagtcaaacatacggtaccattatggccacgccgaaagcgggctggagacactatcccattttgcaaaccgttaagaacaaaatgaaaatcccagtcggatttagtacagatgtcaacgctgcggcgctgggtgaattcattttcggtgaagcgaagggtattgacagctgcctgtatataacgattggcactggcatcggagcgggggctattgtagagaggaggctccttcaggggctgtcacacccagagatgggccatatttatatccggaggcatccgtctgacgtataccaagggaagtgcccttatcatggagattgctttgaaggcttggcttccggtcccgccattgaagcgcgctgggggaaaaaagccgcggatttatcagatatagcacaagtctgggaactggaagggtactatattgcccaagcactggctcagtatattttgatccttgcacctaaaaaaatcattcttggcggcggcgtcatgcaacagaaacaagtgttatcttatatctatcaatatgtaccgaaaatcatgaacaactacttagatttttctgaattgtcagatgatataagtaattatattgtacctccacgtttaggctctaacgccggaatcatcggcacgctagttttggcgcaccaggccttacaagcagaggcagcatccggggaggtgcgatcatgacgcatcctttatttttagagcctgtctttaaagaaagactatggggagggacgaagcttcgtgacgcttttggctacgcaataccctcacaaaaaacaggtgagtgctggaccgtttctgcacatgctcatggcccgtcggctgtaaagaacggcccgctggcaggaaagacactagatcaagtatggctagatcatccagagattttcggttttccagataggaaggtgtttccgctgctggtaaagctgctggacgctaatatggatctctcagtgcaagtccatccagatgatgattatgcaaaactgcacgaaaatggcgaccttggtaaaacggagtgctggtatatcattgattgcaaagataacgccgaactaattttgggacatcatgcaagcacaaaggaagagttcaaacaacgaatagaaagcggtgattggaacgggctgctgaggcgaatcaaaatcaagcccggagatttcttttatgtgccaagcggtacactccatgctttatgtgagggaacccttgtcctggaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtgaaagaagttggtaacgccgagatcactgtttatgtgcaatcagattatttctcagtgtacaaatggaagattagcggccgaactgcttttccttcatatcaaacctatttgctggggagtgttctgagcggatcaggacgaatcataaataatggtagtcagtatgaatgtaatgcaggctcacactttgtcttgcctgcgcattttggcgagttttcaatagaaggaacatgtgaattcatgatatctcatccttaatgaatgggggagttgcatttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacacattttctatggctgaggctgatagaatccgaagcgtcaccgggcaatcgcctgctatttacggctgcgattatgccagaggatggcttgaaacagcaaatattgaagattcaatagatgtaagctgcaacagcgatttaatgtcgtattggaaaaatggtggaatccctcaaatcagcttgcacctggcgaaccctgcttttcagtcagggcattttaaaacaccgattacaaatgatcagtataaaaaaatactagattcttcaacaatagaaggaaagcggctaaatgccatgctcagcaaaattgctgacggacttcaagagctggagaaccaaggtgtgcctgttctgttcaggccgctgcatgaaatgaacggtgaatggttttggtggggacttacattatataatcaaaaggataatgaaagaatctctctatataaacagctctacaagaaaatctatcattatatgaccgacacaagaggacttgatcatttgatttgggtttactctcccgacgccaaccgagattttaaaactgatttttacccgggcgagtcttacgtggatattgtcggattagatgcgtattttcaagatgcctactcgatcaatggatacgatcagctaacagcgcttaataaaccttttgcttttacagaagtcggcccgcaaacagcaaacggcagcttcgattacagcctatttatcaatgcaataaaacaaagatatcctaaaaccatttactttctggcatggaatgatgaatggagcccagctgtaaacaagggtgcttcagctttatatcatgacagctggacactcaacaagggagaaatatggaatggtgattctttaacgccaatcgttgagtgaatccgtaatgtcacaattaagaaggtgctcaagaagtttcttgagcaccttcccactggattaagcattcatatcgcctaacccaggactgtgttcatttggtatttcaggaagcactggtacgggaaagcctgccggaggatctattacttgtaactctccgccatttcggcttggagatttcccttgatagatttcactgattctcgtttcatccaacctaaagttaaactgtgcattatggtagcctaattcgacatactttctgcactcaggatatttattaatgtcataattcggcacagggagcagcttcgcccattcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtggttatacacccacgacccgttccacggattgccccctgcatcaacaggaagggaactttgcgctccaataatataatgatgaggattagcatgtttaaccgcttcatcaagtggcgcttgatctgtaccttgactgccgacaccttcaccgcctgattcatctaataaagcattgattgtgttttgaaccagttcaacgtgggcaatctcctctaaaaaaatgccgcgaagcagatcgcgatactgtttctgctttcctctgaaattagagctttggaaaaaaaactgcatcattgtacgcatttctccgtaatgaccgcctaatatctcctgcaggaccttagcagctgccgggtctggcttgtccggtttaatgatattaatcagttcctctttgtagtaatacataacacgcctcatttcttcttaagagattttcttatattatttgtaagatgagataaaatatatacatgataagcatgggaaggcgtgaaagaagaaaataaaaaaatacaggaaaagtgttgaccaaataaaacaggcatggtatattattaaacgtcgctgatgaacagcgtgaaacaaaacagaaaaacaaaaaagtttttctaaggtgtttacaagatttcgaaaatgtgtataataagataagtcgaattgaaaaagattcgaaaaacatttttaaaaaacttcttgacttcaacatcaaatgatagtatgatagttaagtcgcttgataagcgcccgtagctcaattggatagagcgtttgactacggatcaaaaggttaggggttcgactcctctcgggcgcgccatataagataccacgcgggtgtagtttagtggtaaaacctcagccttccaagctgatgtcgtgagttcgattctcatcacccgctccattattgaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcggggtttccccctgtgagagtaggacgccgccaagcattacttttatcatcgcggggtggagcagttcggtagctcgtcgggctcataacccgaaggtcgcaggttcaaatcctgccccgcaaccaaatatatgattaaataaggagtgccctaagggtgcaaccaaaataatcttatacaaatatggtccggtagttcagttggttagaatgcctgcctgtcacgcaggaggtcgcgggttcgagtcccgtccggaccgccattaatgtaaacgaaacgatcatgttttcgttttttttgtgttttcttttactgtatcttctgcttggtgtcatagccaagctttctttatatcgggaacatcttggatattccagcaaaattcgataaactaggaagagcacatataggcataagcagggttgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtacacttcaaattacactattcctcacctgaagatatcgggtataaggcgttagccgttaatataagtgatattgccgcgatgggaggcattcctaagttttatctggtatcacttgcgataccttcaaaatggactgaatctgaaattaaggcgatgtatgaaggaatgaatgaactggcgaaactatatcatatggatctgattggcggcgatacagtttctaccgctgacaaattagtcgttacagtcactgtgatcggtgaaattgaaaagggacaggcctgtttgcgcagcttggcaaaaccgaatgatattgtgtttgtaaccggtgaaatcggttcttctgcagcagggctttctttattgctggaagagactaatcctcaaaactcatctgtggaaacggattactttatccacaggcataaacggcctgagccaagagtaagcgtcggcagattatgctcgatttttaaacgggcagctttaaatgatgttagtgacggattggctagtgaactgaacgagattgcagaagccagctgtgtttcaattgaaattgatgaaagcatgcttccaattcattctgatttgcctaagcttcatcctaactggaaagaatgggctttgtttggcggtgaggattttgagctgacagggacggtttcaaatgaggagtgggaagtgttgaagcaacagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgacttgtgtgaagcaattaaaatggagaactgtaaatccagaagaaacaaaagcaattgccaagctgacggcatcgtttgctaaaccgggagacgtcctgacattagagggcgatttaggtgcaggaaaaacgacttttacgaaaggttttgcagaagggctgggaattacacgtgttgtaaacagtccgacttttacaattataaaagaatataacgatggcgtacttcctctttatcatatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacaccgttatagcagaatacattacatacttgaaaaagaaccactctgtaagagcgatgcctgctgttcattcattgctgaatgattgtgatatggcaccgcaggacctttctaaaattgtcgttgcaaaaggccctggttcatacacaggagtaagaataggtgtgacgttggccaaaacacttgcctggtctttagacattccaataagtgctgtatcaagtcttgagacgcttgcggcaaatggtcggcattttgacggtctgatcagcccaatctttgatgctagacggggacaggtgtacacaggtctgtatcaatataaaaatggacttttagagcaagttgttccagatcaaaatgtgatgctggcagattggctggagatgctaaaagaaaagaatcgttctgttttgtttttaggtcacgacacttctattcacaagcagatgatcgaggatgtgcttggaacaaaagggttcattggaactgccgcccagcataacccgcgtccttcagaattggcttttctcgggaaggaaaaggaagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcacgtatacgaaatcgaagcatcctcctttacgtctccttggacgaaggattcgttttatcatgagctgctggaaaatccgtatgctcattatctcgtgattgaaaaggacggccatcttgctgggtattgcgggatttggattgtgatggacgatgcccaaattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaatgtagtagcctctcaaattgaaagccataagcgcttcggaggcgttgttccggaaattgcttcaagacatcatgttgaacaaatcactttggttatagaagaggcttttcgcaaagctggcatgacgtatagtgatattgatgcgattgcagtaacagaaggtccgggactggtgggagcgcttcttatcggagtgaatgccgctaaagcattgagctttgcacataacattccgttagtaggcgttcatcatatagccggtcatatatacgcgaaccgtcttgtagaagacatcgtgttcccggcactggcattggtcgtttcaggaggccatacagaactggtttatatgaaggaacatggatcatttgaagtcattggggaaacccttgatgatgcggcaggagaagcctacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctccggaagatttgtctgccagtttccaaaatagtgtgatcgatgtcttggtaaccaaaacggcgcgcgcggcaaaggaatatgatgtcaaacaggtccttttagccggaggagtagctgcaaacagaggcctcagagctgcattagaaaaggaatttgcccagcatgaagggattacgcttgtcattcctccattagctttatgcacggataatgctgcgatgattgctgctgctggtacaattgcttttgaaaaaggaattcgcggtgcatatgatatgaatggccagcccggccttgaattggcttcttatcaaagtctcacgagataatagcgtgagactttttatatgtttgttattaacagacaattcacaatttatccacatgtctgtgagtaattatagagatattgatggataaagggctgaggtcactgttaataaagtggataaattcagaatattttgtggatagtgtgtataaagcgcttactttgtttatttattaggggatgttctgtggataaaaagcacctctaaaaagaggtgcttgacttttttaatcttcttctgtggatagttcttcccattcggccaaaagagattccagctcctgattaagcttctcattgtctgcatggatagcttgtactttttcatgatcctgatagacttcagggtcacatagcaattcatcattgcggctaatgttctcttcaatggtttgaacagtggtttcaatttcttcaatccgacggaggcgttggcgctctttctttttccattctttttcttcctcgtaggaacgtttggagtcagacttcactgtagctggcgttttatcagtttcctcttgctgattcattttctccaattcaagctgctctgtttttttctctgtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttcgcctccgctcagtgaatgaactggtttcagcacatcatctccggagaataagaaatttccgagacacgttctgatttctttttctgggagcccggggtactcgtcccacagctcatcaaggacacgtttagaggaagtcaactcagcctgttcctgatcataatagccgacactgacatttgagccgtatgagatcgttccttgatctggttttagggtgtctatcaatgttttcagcaatgtcgatttaccaattccgttagggccgacaagcgctgcgctttctcctcttgtgagcatgaatgacacttctgttaaaagcggcggctggttttcatagctgattgtgagatcctgaacacggaggacttcatttccgctctgttttgtaatatcaaaatgaaagtttgcagatttttcatcgccaagcggttttgacatgacttccattcgctcaagctgctttctgcggctttgcgcccttttggtggtagaggctctcgccagatttcggtctacgaagtcctgcagctttgcaatctcgtcctgctgcttttcatacattttcagatctttttcatactgcgcggctttttggtcgagataagcgctgtagttgccgtgatactttttgctttctgctcttgatacctcgtacacctggtttactactttgtccaaaaagtagcggtcatgcgaaacgatgaggatggcgcctgaatagccttgtaaataatgctcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatcttacatccgcttcatattgatagccgcctttatctttgaattcctgctgaaggcggtcgtaggttttcatgatgctttctaattcacccgggtcagctgccgccattttttcttccatagcccgcatttccttttccattgcttttaagtggtcaaaaacagtcagcagctcttcttttatggtaagcttagaatccaagccagtatgctgggcgagatatcccattgtaatatctttcggtttaataatttcgcccttttcatacgaaagctggcctgcgataattttaaggagcgtggattttccggcgccatttcttcctacaatggcgatgcgatcacgatttctgacttccagctttatattgtttaaaatagtatcagcaccaaatgatttggacagctgattaacttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatatcagcgaaaaatcttcgactgtccgtactgcggcggctgtttcaagcgtacacatgaagaatgaagtgtacgagaaaatacaaagtcacgatatcggcaaaggagatgtactggctgtcgcacaggtggcaggcattatggccgcaaagcaaacgtcgaatatcattccgatgtgccatccgctttcattgagcggggtagatatatcgtttgactggaaaataaaagaagcagaagttatacttcatataaaagcacaggtcaaaacgaaagggagtacaggtgtggaaatggaagcgctcacttctgcatcggtgtgcgctcttaccgtttacgatatgtgcaaggcccttgataaggggatggtcatcggccctactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatctgcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaataataacacaaaaatttctatggcttttgatataaatgagagtaaaataggaactgaggtaggcggcgtgcccgtctataaccttgatgaccttgaacaacacgtaaaagatgaatcagttgccattcttacagtgccagcagttgccgctcaatccattacagacagattggtcgcattaggaatcaaaggaatccttaattttacgccggcccgtttgaatgtgccggaacacattcgaattcatcatatagatttagcagttgagcttcagtcactggtttattttttgaagcattattcagttttagaggaaatcgaatagagggaaaggaggagcccaaatatgccgatcggtcctggaagccttgctgttatcgcaatcgttgctcttattatcttcggtcccaaaaagctgcctgaattggggaaagcagcgggagacacacttcgtgaattcaaaaacgctacaaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttattgctggattttttttagcgaagccgattattgtgtatctgcaagaaacagatgaagcgaagcagcttacgcttaacgcgtttaacctgacagacccgctttatgtgtttatgcagtttgcgtttatcatcggcatagtcctgacctcgccggttattctttatcagctttgggcttttgtgagcccgggtctctatgagaaagagcgcaaagtaacgctcagctacattccgatctctattttgctgtttttagcgggcttatctttttcatattatattttatttccttttgttgttgattttatgaagcggatttctcaggatttgaatgtcaatcaggtgatcggaattaatgaatattttcattttcttctgcagctgacgattccgtttggactgctgtttcaaatgccggtcatcctcatgtttttgaccaggctcggaattgtgacaccgatgttcttggcgaaaatcagaaagtatgcgtattttacgctgctggtgatcgcagccctgattacaccgcctgagcttctgtcccatatgatggtcacagtcccgcttttgattttatatgaaatcagtatccttatatcgaaggccgcctatcggaaagcgcagaaaagcagtgctgccgatcaggacgtgtcttcggggcaataataaaaaatccatttctcatgcgagaaatggattcagcgtgttgacaaacccccgcatttgttgtcaagcctgtgcgttggtgctcacgaatgaaaacattcgctccgctccaatgctcgcctttcctagacttcaagggttttcaatcacgctgaaaatgacaaaatcctaacacgaaagccgttttaggatttaatttgaatccatttctcattcagaaatggattttctttatttttggttctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcaccctacggcaaagtagatcattccccaaactaccgggtttctcataaaaataatcctccaataatcaattgcatttgtgtgctctgttgttcaaggtaattccgaacaggctcaagctgcatgatgacgacgaatgtattcatcattaaatgggcgaaaatcggcacccatatccgttttgttctggcatataaaaaggcaaaggtaaagcccattgctgtatatagaagaagatgcttcaaatcagcgtgaacaataccgaaaataaccgagctgatcagtcctgcaaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatgccaaaaacataatattcaatagagcctgctattccttgagagaaaagggcaatgaaaaaaccggctatcgcccaaaggatagaaagtccgattgagtccttctgtccgtttcgcagcgtttctttcggaacggttctcagaatgagcagaacaacaacgagacaggcgataaagctgataacggaccataatccttgtgcatgcagcatattttcatctgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagggagcggaaaagaatgatgtaagcgtgaaaaattttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttattggctaattcttaaataaaaacatttaaaaattcgaggaggtactgtaaacatggcaaaagatattaagtttagtgaagaagcccgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgaactcgaagacgcgtttgaaaacatgggtgcgaagcttgttgctgaagtagccagcaaaacaaacgacgttgccggtgacggtacaacaactgcgacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcagttcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgcagaagacgttgaaggcgaagcacttgcaacacttgttgtaaacaaacttcgcggcacattcaacgcagttgctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgaattcgacagagaaaaattacaagagcgtcttgctaaacttgctggcggcgtagctgtcatcaaagtcggcgctgcgactgaaactgagctgaaagagcgtaaacttcgcatcgaagacgccctgaactcaactcgcgcggctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacacaacgctggccttgaaggatctgtcatcgttgagcgcctcaaaaacgaagaaatcggcataggcttcaacgctgcaactggcgaatgggtaaacatgatcgaaaaaggtatcgttgacccaacaaaagttacacgctcagctcttcaaaacgctgcgtctgtagctgcaatgttcttaactactgaagctgttgtcgctgacaagccagaagaaaacgctggcggcggaatgcctgacatgggcggcatgggcggtatgggcggcatgatgtaaaaccgacaaaaaacccttgatttacaaggggttgtcggcaacggacgtcatttttatgccctattgatccatttataaattttcgaggcttctcatgagttcactgaacttgtgagaagcttctttttttctgtcttttttgatgtgtaaataaacctgtgtagtatgtacgggcatacatggcatttatggaccgaaaacaaaagcaaaaaaggaatactgagtccttttctaaaatcgaagcagacttttttgccaaacacgtcatctgcaattgatattattttatctggcattttaccgtctcgataacgattagaaacgtttactatatatgactcgctttctttatggaagctatgtaagtatcagaatgcaatttcttccctatcttcaagatcaaaagtttcaggaaaggggtagcgccgaatagattttgacatattctaaataatcttttgggaactttacttgtaatgtgtcttctacttcattaatttccttgttactaacaggttgctctccgaaatcccattcaatcatatgaaatctccgcctcgatatgtaaaacccttctttatgtaagaagagttttaattttattcagcctttaaatatgtccggaattttatcttgccatattaatagcaattctctaaattgatcggtttcaattgagttttcatagggttcttctatcctaaaagagttttcaacaattgtcacatcttttttaatgagaacacttgtagcatttaactcaatctcaaaatcttcatatatcccttctaaaaccttctcaatgtaatctatatactcgttggcttgttcttctgtagcgatgttttcaatgaaatcagagaaaatactgatttcttctggcaatactattcctaaatcaccaaatggatcttcttcaaatttatatggatatttcatatgttatttcaccttcaagattattttttatataacgggtatgcagttgctattgttccatccttatttaaatacatttctatttttatacccgacgcagacatgcccctgaatttatttgagccgatttgctttttagtttggtaagcttcatcaatagcttttaatacatctgcacggttccactctcttgggaagaaactagaatcagctatttttttaacaccgtcaacctcaacctttgccatataaactccgtttttatcaggttttttttccgtaccctgaataatttttccgcccatcatactttcatggtgataaccaactgctttaccgcgtttatttatttctccatggtagatgtgcttcattgtacctgtggtatactttccattacccgaactgaaattagatgttgtagatttagttaaaatactctctttttgattttcaataatactttttaacaaaggagtattttttgcattatacgtattgtcaatatctttagctatccctacaagtgcaggttcatatttattttttaataaggggttaataaagtcttttccctttaaaagccctttattgacatgagcagcggctgttccaccttcaactactttacctactttagaaagcttggtagtcgtttgcactgcggcacctgcaccttttgggccaacgatatttcctatcgcataactgatataatgccctttttcgtatgcatcgccatttaccattttatcattccatgagtcgatcaggtttgtccagatgatttttgaataagagggcgcgcttaaaactgttgaaattgtttttgtgagttttagttcggtgggaagctgtgaatattcccatgtaccaacaaccaagtctttgacgccatatatcgtatcgtcaatcacatcgtcaattccatcattaactccgtcgacgaagtcaattactgtcttaccggtattgattacactttcaccgacggccttcagctgttttgcttgttcaagctgtaccacatactggagctgttcaggggtaagattctcatagccgaccttcttggcaatttctaagtattcatccggatcagtcactccgtcagctagcttcttcttcaattctttgatttctcgttctttcgcttcatctttcttgatcttcaaataaacttcagtctgtttctcaatatcgccttttttcttatgtatgtcactttcacggtacgccttggcgttgtagtgaatgggcgtagcgtttttgcctttgcctgtggattcctcaagcttttggaagtccttcttgatgaattgctcgtttggctctgactgggcatattcagtaacaagtgcttcatccacgcttcctaatttatcgactgtttttttacgtttgtcctctgcatctgcaagttcgtctttgaagtcttctgtcgagaacaaatcaagcggaagaatatcgtcgatatcatttaaaatatctttcatcgctttcttctgttcagacataatggattttgattttgtgtaggcgttagccagctcgtgttctaagaaggattcttctatatatgcatcagataagctggcgtcctctaaaatgcctgaaatacttgccaagaaagcaattttcatatcaagtaagtcaatccaatcgccagctacacctgcgtggtcttgataaaatgctttaatgttgtcagcacctttgccggaaaactcactgtcatctaaatcagctacagctttaaaagccttttttagattgaccatctgacttcttaattctttgtattcctttgcacgtctatctgcttctgaaagcagtgagttggcttcaaatactttcatgttcatatcctttcgtttgaatagctccaacaagattttaccatggggaaatgaagaaacagactaaatgtgatacaaaagtggtgaaatggtcaattttaactatgtcattttacctatctgaatctcttgtttgggttaccgccgacgcctatagctagaagggctttctacagttagatttatagaccgaaaaaaattgaaggttattgaaataaataactccctctcatagagagagagggagttatttatttttgttataaaaattcattgtaaaaaaagataaaactaataaaactagaaaatagactatgaaggttgagataaagttccaagagaaaaagttaaagtctttatttagagaataaaatacaatttgacttactaaagttattacgaaaacaactgttattaatttagagaattttttggtcatgacaaaacacctcttccaatttagttaaataaacccatttaatatagtagaatgtttggtaaaatatagtatgtaaataacgattaggaggatgttctatgaaaaagcttttagctgtagtgttaacatttactatgataacactaatgttcggaagtacgtcaatagttcaagcggaggaaaagtgtccaacctgtgagaaaacagatcctttggtagcacctaccacaaaagatctaaataaaactattgaaatattaaaagacaataatgtgaacacgttagctttggataaagaaaaagctgcagtagtcgaaaatgataaagacaaagctgtaattatcgcagaaaagctatgtgatagtaaagataagattgagtataaccagtattttgttgacgttaataacgaaaaatttgtaactttaaaacaaaaagttgaaaaactagatgataagactgtaaaagctgaagtcataaacgtagaatcaggagcaaaatactctgttacaattgataaagatggaaataaattagatgaaaattttatttcaggaaagtctgctgattttaagcaatcaagtttatgtagtgctatcgtaggtgcagttcttggtacaggatctaaatttgcttgtattgcagcttgtacagctgtaactggaggttggggagcagttgcatgtggtgtattatgtgcagcagtaactggcggaataagctgggctggggcaaaagatatgtgtgaacaattattcggttgaaaaacgacgctcctatataggagcgtttttttatcactagtaatatggggaaattaataaataaactaaaacacccgtaaggctaacatacagccaaattggcattgtccaacgtactatttttcggtgtttttgtgtctgcattgttaaaccccaaattaatgaaaataacgctaacggtacgacaataccagcaagaatactatgagaagttagaataatgtagtaaaagtatttggcgagcccttctcctccataatgagtggtctcttgagataagaagtggtaagttaaatacgaaaataaaaataatattgttgaagaaaatgctgcaagtatgaaagctctgtgaagtttaatgttatgcttttttataaaaattaaagctgctataagaaagatgaacgtaaagctatttagaacagcatttatacgaggaaagatggttatattaaaattcacctcccccttataccctaaaggcgaaaaaaataatagcaagataatcacattagctaaaagtgaaagtgtgattactgtttttgtataatttgagttctccttggacctttgagtctttattctattcaaacttttcacctccctctctaaattaacatgattttttccataatgggccctatatgaaaaaaacaaaacttaattcctattctacacaatatctatttaaggttgtaaaagttattatataagtatgaaaaaatattttaatacagttcatgagatattgccgtttcgctcattttggttattgtgatcgttgcaattaacctgaccgatgaggtatatctgagctgattgcgcatactgtattgatgatagccgttgtttttaccttgttaaaaggaaccattataatgtggagagaatgccgacatgaaagaaaacgaaaaaattaagtttatccagaaagaagttttgactgcagcggaagtgggataactgctcggaatcactcggcacgtttaagctacttttgtgacttcacggaagctcaagcctgttaaaaaaggttgggacagttgcaatgtttttgtttgaacatgtataagcctttaaaaaagaattaaaagccggccggaagaaggccctatgataaatgaagctcctcttatattaaaaggagctttcgtacgtttttatgaaatcctctcatataaatcatcacaacatgtggatatatgggtgcaaaaattaaaaaatggtgagatatctatcaggtgaaaaaaggacataaataggcgcaatgcatggggtggaatgatgtaatctgccctcctaggcccttgatatttagggattcagaagttatttttactctaagaagacttaaaatatcagggattagtgagacctttcatacattcgatgaatgtacgaggggtctctttttattggttatgtgtaattcgtaaaaattacaagacgaattgttgactgggtagttatagaatgatatgatttaaattgcaattagattaagtaattttaaagaaatactttttgaagagggcgggatatgcgacttgaagagattgtaacagttaaaatagggagaaacctctctagaggacatgagaaaaatgatccgacattagttgcttatacatatgaggatttaataaaggatttagatggctcgtttctagactcacaagttagtcctgatgttgaacaatcaaaccataaagaaagctatttgagcagtgtcggggatgttgttttcagctttgtcagttccaaggctgggatcgtgagtgacttaaatcatgggaagatcatcaatcaaaactttgcaaaactcatgattgaacatattgatttggatagtcgatatttatgttatgcattaaatgagtcgcacgcaatgaaaaagcaaatggcaatttccatgcaaggaagcactgtgccaaaattgactcctgcaatattaaaagaattggagatcaaattaccaagtattgagaaacaacggacgattggaaatgcttatttctgtttgagaaagcgtcaagctttggcgaagaaacaagcggaacttgaagagcaactttatttagaagcattgaagagattagaccaacaatagaaaaagtgaggaacacaactatggctgaattacactcaaaattatttagtgccgcagacaacttgcgaagcaaaatggatgcatcagaatataaaaactacttattgggattgatcttttacaaatacttgtctgataagttattagaaaaagtcgttgaaatcgcagatgaatctttagaagaatacaacacacaagaaaaacaaacgcaattgtaccggaatttattagcggatgaagagatcaaaaatgatttgattgaaacgttagtggatactttgggctatgatattgagccagagtatttattcaatgtattagccaatcaagcgaaacaaaacacattccagctgaatgacttaaataaagcatttatcgatttgtctacgaaatatgaccaattcaacggtctttttgatgatgtggatttgacatcgaaaaaactgggatcggatgatcaacagcgaaacatcacgattactgaagtattgaagaaactaaatgatgtcaatgtaatcggtcatgacggagatgtcattggggatgcctatgagtacttaattggtcaatttgcctcagaagctggtaagaaagcgggagaattttacacacctcatcaagtatctgatatgatggcgcgtattgccgcaatcggtcaagaagacaaaaaattatttagcgtatttgaccctaccatgggatcaggttccttgatgttgaatattcgaaactatattaactatcctgaaagtgtaaagtatcatgggcaagaactaaacacaacaacttttaatctagcgaagatgaacttaattttgcatggtgtgaataaagaagatatgcggttacgcaatggggatacattgaacaaagattggccgacagatgagccttatacctttgatgctgttcttatgaatccgccttactctgcaaaatggtccgcagatgctacatttttagatgattcacgtttcaatcgttacgggaagttagcaccaaaatcaaaagccgactttgcttttcttttacatgggttctaccatttgaaagattcgggaacaatggcgatcgtcttaccacatggagttctgttccgtggagcggcggaaggtgtgatccgtaagaaattattggaagatggcagtattgatgccgtgattggtatgccaggtaacttattctttggcacatcgattccaacaacagtcatcatcttgaagaaaaatcgcagtactcgtgatgtgttatttattgatgcaagtaaagagtttataaaaggaaagaaccaaaataaactttctaaagaacatattgataggattgtcgaaacgtatcaaaaacgagaagatgtcgcgaaatatgcccacgttgcaacattcgatgaaatcaaagagaatgatttcaatttgaacatccctcgatacgtcgatacgtttgaagaagaagaacctgtggatatggctgcgattggtgcatccattaaagacattcgaaaagaaaaagaggaactagagacaagcttgtatgacatgatttcttcactacaatatgatgaagaaaatgctgaatggatcaagggtgcgttagaggtgtttaatcgtgggaaataaacgaacaccagagattcgattttcaggatttactggagaatgggaacagcgtcagataggtaatcatgcagaaatattgacaggtggaactccaaagactcaaattaaagaatattgggaaccaagtgaaattccatggatgtcatctggtgaggttaataaaaaacgtctttcatcaacggacaacatgatttcctttctaggattcgaaaattcaagtgctcgttgggtaaaagaaaattctattttaattgcattagctggccaagggaaaactcggggaacagtggctataaatgagataccactaacaacgaatcaatctattgcagcaattgttccgaaggaggaacttcactacgagtttgtgtttcagagtttagaaaaaagatatgaggaattacgattaatttcatctggtgatggaacccgtggaggtcttaacaaacaattagttgctgatgtagtaataatatcaccatcaattgaagaacaaattaaaattggtgatttgttcaaacaactagacgacataatcgcacttcatcagcaagaactaaccaccctcaaacaaacaaaacagggattcttgcaaaaaatgtttccaaaagaaggggagtctgtgccggaggttcgtttcccgggatttactggagagtgggaacagcgtaagtttaaagactttatttcgaaggctggtaagaaaaatacaatgggtgaaaattatccagcatattctgtaagtaataaagtgggactagttagccaatcagaacaatttgatgggagtcgattagataatcttgataaaacatcttataagctagttaatcctaatgaattcgcatacaatccagctagaataaatgttggttccatagcattcaatgacctcaataaaacagtaattgtgagctcactttatgtaatattaaaaatgagtgaggaattggataatgagtttattttacaatttattaaatcgcaattttttattgatgaggtaagaaaaaatacggaaggaagcgtaagagagtatttattctttgaaaattttaaaaatattaagttcccttacacttctagcaaagatgagcaaaccaaaatcggcaccttcttcaaacaactagacgacacgatcgcccttcaccaacgcgaattagatgccttacaagaaacgaaaaaagctttcctacaaaagatgtttgtttaacgaataaagggggggagaaacatgacaacgatccagcataaagatgaagcagaggtagagcgccgcctgattgaagtgttaggcgaagggtataatcagtggaattatcgtcctgatttaaaatcggaagctgacttgtgggagaacttgcggcaaaagattacacaaaataacttatcagaaattggggaacatccaatgactgataaagaattcgattcgataaagacagagttgttatcgaaaacacagacaccctttgatgctgctaaatggctcaaaggggaaaatggaattgctcggattacgattgaacgtgaagacgtttcattgggttccatgtcattggtgctgtattccaatcaagatattgggggcggcatttctacatacgaagtcgttcatcagattgcgaaacaaaagagtcacgttgatggtcgtgaccgccgatttgacgtgacacttctcattaatggattgcccattgttcaaattgagttaaaacaggccagtgcaaaagacggtgtattccaagcctatcatcaaattaagaaatacgcagaagaaggaatgtttcgaaacaatatcttttctaccttgcagttatttgtcatttctaacgaacaaacaactcgttattttgccaacgctttgccaaaagatatccataagaaattcatctttagctggcggacaacggataatcgaaaagtagaaaatctctatgagtttgtgaaacaagtgttaaacattccagatgcacaccgtttgattgccaattatacaattgtgagtgaagaccaagacaacaaagctctagtggtgttaaaaccgtatcaaattcatgccatagaagccttgtttacatccgccatgaggcatcaatccggctttgtttggcatgcgaccggatcaggaaaaacgttgacaagttttgtgtctaccaagttattggctcgcaaagcaggtgtagaccgtacgattatgctgattgaccgaaaagacttagataaccaaacaacgacagaattcactaaatttgcttccgagtttaataccggtatttcttctggtgatgcaatatcgaatagcttgattgtcggaactggaagtgcgaaggagttaagtgatactctactgtctgatgccaattccaatacagtgattattaccactcgtcaaaaactagaagctgccttgcgctatgcccaaaggcaagaggagcaaaaaggtactcagcgctttaagaaactgctgggacaacatattgtctttgtcgtggatgaatgccatcgtgcgttaagtgcagaaggcatggaagtcattaaggggttctttccaaattcgacttggtttggatttacagggacaccgatatttaatgaaaataaaaaacaagcgaagggccgattagctcgcactactcgtgatcaatatggagacgttttgcacacctataccattaagaatgcgttagacgatggtgctgttttagggtttcaagtagagcatgaagatacaattgaccccacttcattaaataatcatattttcgaacagctgcgtcatcaagaaaaatacgccaattgtagtgatgatgaaatcaacgatatgattgatcgaatggatggaatcgaaaaagaagcataccttgaaccatcttcgttcgagaatgatgaacatattcaaaaagtcattcataagatttttaggccggataatgcctatattaaatttgattttcaaaacggccgcccgcaaaaatcagctattttaacaacaagttccattgatatggcgaaacgttactatcaggcaattaaagaaatgacgaaagatccagattggttaacaaaagagtttgcgggacacccgatccgaacagggcgtacaattgaggatcctgattttcctcggattgcaattacgtattcaatgcaagaaaacgaggaagattccaagcaaactcaagatgaaatgatggagattattaaggattataacggttactatcacactgcttggtcgatagaagatattgaacgatataatggtgatattaacaatcggttagctcgtaaaaaaggggaatttaaagaatttgggaaacaaattgaccttgtcattgttgtcgatcggttattgactggttttgatgccccaacgattcaaacgttatttgtggatcggaatttaagttatgccaatttgattcaagccttttccaggaccaatcgtacgtatccaggaaagacaaaaggattaattgtcacattccgtaaaccttttacaatggaacaaaacgtaaagaatgcgacgaagttatattctcatgcacaagaggaatctagtcttgtttatccaacgtatgatgaatcgaagaaacgttttaagaaggctcacaaagcgctaactacattaattcccaatccaaccgatattgatgagaacacatctcttgaaacccgaattgagttcgtgaaagcatttcaagagctaaacaattcttacgaagcgttagtgacatatgatgactacaacgatgatatggaaaaatcagcagcacttcaagaacaggtggaaacactagaagaatatattggtatctatcacacgattaaaggttcacttatagatgaagaggaccaagatggagcggaaccggatttttcagacattgagttttatggagaaaatgcagtgaagatctatgatattgattcaacgtatattgatcgactattagaaacatactcggccaataaccagaatatccgtgatgagatcgaaagcgcacttcaaaaacttgagaaatcagacattgttaaagatgtataccgtgagatgttaaatgccattgatacgaaaaaagtagatgaagaggaagatattcttgtagtgaaaagacgcttcttcacgaaagaacgcagccaagcagttagggaatttgcgaatacttggtttgtggcagaggatgaactgtatttatctgcagttcaatatgtgataggagcagatcctattccgaatatcgggggaattatcaatagcaagcaatttgatcagtataaagccgtacacccagatgcaaaaccgttgaaatacggaccagagttgaagcgtcagtggagaaagatgttagatgaagtcattgtacctttggatggcgagctgagataaagacattttgaattaaaggaatctatataacgaaaggccaactgcgacttgagttggcctattctgtttattattaaagaaacagtgtaagattgctgacagaactactatgcgtattagtcgttttctttagtcacccttgccaatcgctccacctctccccgaatcccaatcgcaggctcccaagaatcaattaaacgaatcgctttttgattgaattccatcgctttcgttttctctcctttactgtacaacaactgtgccatcccataataataatagatcagctcaacctgattcgcgttatgtttgtcatagagcatttgctcaaaggcttcttccgctttctcaaactggtcacacttcacataagcaacacccaaattgaaataggcttctatcgttttttcgccgccgtacgtggagctgatctcatttgccgcttcgtatagttgaatggcttcttcatcaaggtctctcgcaaagcttaggtctccgcgaaccaatagaaccctgtgttgaatcgtaggggaaatcggttgatcttcgattttgtttaaaatggtcattgctttttcctgttgcccggcttttaaaaacagccttgctttgagtgcatgtccccaaacctttagatcataggcatcgtgagcgtctgattgttccagaatcctcagcccggcttcaatttgctgtaaggccctgtctaaatcattgacttccatcagagcccagcctgctgtgtcgattcggaagaacgcttctcgtgtgtgttggcctaattgatgggcggcgtcggcggctttgcgcccgtattcgattcgcaggggcaggttgattctgcttagaaaatggctgatgcgggtgatgagttcgattaggatttctttttgatcggtttcacttgcccattggatgacctttaagatgtttggccattcttgtttcatttgatctaagttccgtcccagcaggtagctccaatagatagagttgggctgttcccgctttaaatgggtttcggcataatcaatataatagtgagcccagcgattgcgggcttctttttcatattcgtgctgttcggacaagtgctgttctccgtaagcgacaacggtttggtgcgctaagtattgtgtcctgccttggcttcgttccggctgaatcagcgcatatgaccgcatttgctccatagcgtaatgaaaacggcgggcgtctaatccggctgctgccgccaggcttttttcatcaggcggcttgctgaaaaagcaaagcgtctgccatagctttcgcgtatcttcattgcatctatcccaagtgcggccaaagaggaattcaaacaattccagcagtgagtagcctgcttttccaagctcatgaatcagctgctgagcggggatgtcatcgtctgacatataggcaatgctgagtgccatggctttcgggtttccggcagtcgctgaaatgaattcgtttttcaggtcagatgatagatgtaacagctgctccagcttttcccgtttattttgaatgttgcatgtttgtaagcatcggtgcacttcttgctgaaaaaaatccaaggcatctgtttgctcaaggccgctcagctgaatagctgtcatttctccgaagctttcccgataggtttgctttacgttttcccgcgctgtgaggagaactttcacgccttgcggaaggctggtgataaattcatgaatgtcacgttctgcagtatcaatgctgtcaacgatcagcaggatcggtttttctctagtgtaattagctaacgcattgcggacgacgaatcgtttttcattgattgatttatcgatttgttctgtgcgtccgagctgataggcgatcgtatttaaaaaatcgctaaagctcaatcctttccaatcagcgctgacccaaatgatactgttgaacgtcggccaatctgaagtatcgccgacacaggaataggcggcttcaagagcgattgtggttttacccataccagcccagccggtgattaaacagactggtgacggagaaagcatccattgccgtatcgcttccatatcaaagctgcgtccgataaagcgtccggaccagcgtgagggtaaattatgcgtgataggctgttctgtaagcgcattcgtttcatggccgggtctgtcatgaaacagccgttttactacattttcaatttcgtcttcactcggagccccaaataatccgtcttttcgcagtattttcgcttttttcaaacaagatgctgcccatacaggcaatgcgggtttgatgactgggatagtggtggcttccagcaagtcggtcaaccaatcgatatcgaagtcggtcttttcgagaatgatccagatcattccgaacagttttccgtcgtcaattcttccgggaatgtagtttgcccccatctgtccgatccagcttttgatcgtgtttggggagactcccagctggagtgcgattttatctatgtaagactgtcctgttttttcattctttttccttctgactttataatcaggatgaagttttagcgttttgacgccaggtgccagcagttgtgcaaattgttttcggttttcaagttcagccataagcctgcacctcctattagtactattttatcaatccagcgttttttgtatatgaaaaaataaaagtacagtgccgctgtccttttatacagcagaaaaggctgttgaacgtcttgaaaagcagataaaatgggggcagtaacagagaaaataaaaatgtatgcacttacattttattttctaaagaaaggaatttgccaaatgactcacacagtacctcagaacatgaaagcggctgttatgcacaatacaagagaaatcaaaatcgaaacagtgcctgtgcctgacatcaatcatgatgaagtgttgattaaggtgatggctgtcggaatttgcggatcagatctgcattactatacaaatggccgaataggcaactatgtagtggaaaaaccatttatccttgggcatgaatgtgcgggagagattgccgctgtcggatcagctgtcgatcaatttaaagtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagatgctgctttgatcgagccgttttctgtcggcatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctgagtgaacagggaggatcttcgtattctccctcttgtttactggaaatgaaaacggattcttggggtgggaaatgatgattgaaacagaaaaagtaacggcaatgaaagtgaagcatcagtcaaaatccagtaccggactgtcctggtttgaacgaatcggttatggattcggcgatatgtcgtataatattatctttcagtttgtaaacgcatacttattattttattatacagacgttggcggcattcagcctgcggtgatcgcaactttgtttcttgttgtgcgtgtgctggatgctatttttgacccgatcatgggattgattttagataaaacaaatacaaggtggggaaaagcaaggccatatttgctgtgggtggcatttccttttgcgctattcacattcttatgtttcacgacgcctcatttcggtgagaccggaaatatggtatatgcgtatgtcacctatattctgcttgggatgtcctttagtatgcaaacgatcccggtgaacagcttaacggggcggatgacgaattctgtggaggaacgaacggttctgaccacaacccggatgattttggtgtatatcggcattcttttatccatttcctgtgcgacaccgcttgcaactgctatcggaggagaggatcaggcgtttggatttcagatgacggcgctcatctacgcggcggtcagcattgttttgaatctattcagtttctttactgtcagggagcggattcagcctaaaaagagaaaaaaacaagggatcaaaaagacgttatccgttttattccaaaacaaacccttgctcatgttaatttcatcatttttggcttttgcgatcgggtttaatattaagctcagcacgatggtgtattattttacgtataacgtaaaccataaagagttcgtgtttatgggcaccgttttatttttcggggcagcgctgatcagcaatttgtttattcctttcttttctgagaagtggggcagaaaacaagtcatgattatcacggcagctctatcgcttatttcttatgcaggcctgcattttacgccgtattcttcaattccactcattttcatttggcttttcgcttcgggatttttcacaacgcctttaaatacgcttgcttggggaatggttgcggattgtgtcgattatgcggaatggaaaaccggaattcgcgcggatggtgtggtgatttcgagcatgagctttattaataagctgggtgttgcgttagccgggtcattttcggccatttacttaggaatcgccgggtatgtggcgaatacagaccagacagttgggtcgttgaatgcgattaaaaatatgaatgctttgattccgggatttttcattttgctttctattattcttattgccttctatcctttaacggaaaaaagatataaacacatcatctctgagctggagcaaaggtctgcgagataaatatatgtaaaatttttaatattcaatgttgtatttatggcagaaagtaatatactgagactgtaatctagactttataaatgagtgtgataatatgcgtagtcattctgtagtttgtattggggaattgttgattgatttcttttgtaccgatgttgacgttgatttaatggaagggcgccaattcctgaaaagtgccggcggggcaccggcgaatgtgtcagcagcgattgccaagctgggcggagacgccgctttcagcggaaaagtaggaaaggatccgtttgggtattttctgaagcgaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaggatattgaccaggaaaaactaaacgaagcgaaaatccttcatttcggctctgcgacggcactgttatcagatccattttgctcagcctatttacggctgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggaacttgagattatcagcggtgtgaaggatcatgaaaagggtgttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctgattttgtgaaactgcgtgagattgtggcgtttgccaataaggtcggagctcttgtgtgcactaaaattggagcgattgatgcactgccgagcttggatgagatcgaagtttctttgtaaatcattgaagatgtttcttgaaagtctttggacttttgggggcatctttttttattgcttacatttttgttcaggtaaaaagttgtatattttttgtttgaaatgtcattttttattaaaaaagtgaaacttttaacgataataaatagtatatgtaacaagggttaccgaattagctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggccgaggagcagagagcaaaaagagaatatcacgaatgccaggcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagctggaagcacgtaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgactgcaaagtatgacactggcggttcaagccaggttgatgatgaacttgcggcgttaaaagcgaaaatgatgctcgataagtaatacataggaggccgcagctctcggctgcggcgtcattttatcataagatgtgagagggaacggtaatgataatatcttataagtgtccgaactgcggcagtgatatggcatttgatagtgaaaccggctcgttatcctgcagcagctgcggaagacaggacaatattgaaagccttccgaaagaaaacattgcggcacggttttctgatgatgaagcaaaagaatatcaatgtgaaaactgcggtgccattttgatcacggaagctgaaacgacagcaacgacgtgcagcttctgcgggggtgctgcaatacttgcagatcgtttatcgggacatttggcaccggcgaaagtcatcccatttacaatcagcaagcaagaagccgagcaggcatttcgaaagtggtgcaaaaaaggccttctgacaccaagaggtttcatgtctgccgatcgcattaaaagcatcaccggcatgtatattccgttttggatgtttgatttaaatagtgaagtacaggtgagagcaaactgtaccagagtccatcaatatgaagaaggggattatatttgcacggaaacagagcactttgaagcgtttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccaagggcaaaagagaaaataagcagttatatagattcatacatccattctactttttccggatatacgtcagtcaatgtgagggacaaacatattcacacgaaaaacgtgaacagcttttacgttttgcttcccgtttggatggtcagttacgattatgaaagagcggagcatatctttgcgatgaacgggcaaacaggaaaggttgttggaaagccgccgatcagtcgaggaaaagtggcggcatggtttagcggaatagcaggcgggacatttcttgcgttgaagctcgtctcattgatgatgggaggcggattttgatgcggggatttttagggaaagcgatctttggtgtgctggctgtcttcatcatgatgcctttactgggtatcgaagcggcaagagcctctgaatcgcagcagcatgtgtacgatcgcgctcatctattgtcaaaagcggagatcggaaaacttgaatctctctcggcagagctgggtgcaaagagggacactgatttcatcattattacgaccaaaagcacaaacggtgaagatattgctgactataccggcgatttttatgatcgttacggaaaaggcagtacagccattctgaccattgatatgacaaacagagaagtgtttatcgcaggcttcaaaaaagccgaacagtatttggacaacagcaggctcaatagcatcagaaatacgatttcatctgatttatccaatgaaaattattttaaagcttttgagacatatattcagctttcctataaagatatgggcataaaaccgggagtaaaccccgacaacatattctttacatggtggtttcagctgattgctgccatcgcagtcggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggtacgtcatacagtgggagccggggcagtttttaaatgtaagaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacgttaaagggctttaagtttggctttaacagcggcatgcgagctgaggtgctgtttgtcaatacgaaggaatttaccgtaagatggggaacaaaacaggcgataaatattccggcagcgggaatgccaggcgggatgcccattcgcgcaaacggcacatttaatttcaaggtgcaggactatatcagcctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttagatatgcaattaataagcgacgggatgacggtcactggttttcaaatcatgagctttaattatcctcaagaggttcaagatatgattacaaagaacgcttcctacggtatggttggggatgtgaacagataccagcaaatatcaatgacggatggaatggcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtgtaagactcatacagtgaaaagtccggagtgatcagcgctcgggacttttttatttagaagaataagcgttaccgttacctattgcttgctcctgaacaggccattttcgagcccccgcttggataattcccagcagcaattgacgacgttcctttattgaattgacggcaatttgaaatgtttgctttgataaagccggtatgcctgattgttgaagctttgagatgtctggttccggcggcgcttgttctgcaggatggatataggcagtatgaacggtatctagatagtttttgatacttgagcgcgcttctttgatatgaagctgattcggctgatattgttcaggaattccgtatttgaaaatggttagagcctcatccaatacagcaacagctataatggatgattcctgatgctgcgtgctgtggtaaaaatgaaggatggggaaggcgttatgctgagcggtcagctttcccagttctgatgaggcagcgataagaagaaaatcaatgtcgtgaaaatctttgccattccatgcattatggacgatttctgttccgtcatgccctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccggttcttttgattgagtttccataagtgagtgagggtcactcgagtaaatcaaaacccacccgctccaaaatagactgatccatatcactaacgtcaggcataacagcagaggaccagccatacttagaacctttgcgtggtcaccgctgattttgcggcagcccttccacagccaggcagacaggcatcttgtgatcgggccggcaccgctctctaaccataacgtggtccataaaaaatcaatcatccccgctgtcaataataaaaggcctgcaatgatataaccctcattcattttggttgcctcccttaagtcagccttcatttattttcttctctatttccttttatcctgagtctgaaacaattgaacgaatgtttgattttacagagaaaaatgggtgaagttacccaacacttactcatttatcgatatgaatagaaaatcacaggatttttgacttgattcacacattttcatgaagaaaaacgttcattttccccttgaattggtgattttccttttatagagtaaaaaattttcagaaatttatattgactgaaagcatttttataattatgataatatcagatgtaacaaaaatatcactatcatatcactacaattgaactatcaagtgactattaaatgccaaatttacaaggttatgcacaaagaaatgaccattgttcttttagtgagaaatgaaatcgcttccatcaggactgacatgctaagaagaagggaaggttatgaggttgttatgaggttattggataaaaacatgaacaactattttctgaagcctgcttacgaaatgtgaggaaggcagcagccctggaatgagtttttgacatacgcattttgaaaaagactgggggaaacagtatgaataaacaaggcaatcaaatgtcatttttacgtacaattattttagtctccactttcggcgggcttctttttggctatgataccggtgtgcttaatggagctttgccgtatatgggagagccggatcagcttaatctcaatgccttcacagagggtcttgtcaccagttcacttctttttggagcggcactgggtgctgtgtttggcggcaggatgtctgattttaacggccgccgcaaaaatattttgttcctcgctgttatattttttatttcaacgatcgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgctggcttgtttctaaaggaagaaaagaagatgctttacgtgtattgaaaaaaatcagggatgaaaaacgggcagcagctgagctgcaagaaattgaattcgctttcaaaaaagaagatcagcttgaaaaagcgacgtttaaagatctttcagtcccatgggtgcggcgtattgtgtttattggattagggattgcgattgtacagcaaattacaggtgtgaattcgattatgtattatgggactgaaattctaagaaattctggtttccaaacggaagccgctttaatcggaaatattgcgaatggtgtgatttcggtattggcaacattcgtcggaatctggctgctgggaagagtggggcgccggccgatgctgatgacaggcttgatcggtacgacaacagcgttattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccaatattgctggcagccatcgggctgtccacaacgttctttatcttcgttggattaggaatttgctctgtcttgtttgtgaagaggtttttgccggaaacgaaagggctttcgcttgagcagctggaggaaaacttccgggcttatgatcacggcggggcaaagaaggattctgggactgaagtgattggataattaaaaaaagaatccgcacctgagtgcggattctttttggtttcaaattagttaggtctgacaaggattttgacttggcttttctctttaataagagccccgaagccttcctcgatcaaatcatctagtacgatttttttcgttacgagtttgtcggctgagaaatagccttctttcattaatgacagtacagccgggaagatgtcgcggtatccgataattccttttactgaacgttctttgatcacgatatcgttcggatggatttcagcacctttttcccaaatactgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcggttgcaccggcagccttcagcgcttcaatgacaagaagaccgatcgggccgcagccgaatacagccgctttgtcgcctgctttgagtttgcttgagcggacagcgtatagagcaactgcagaaggttcaacgagtgcgccttgttcatatgataattcatcaggaagtttgaacaaaagctcttcatctacagagacgtattcagagaaaccgccgcctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatgggtgcggtttgtcaaccggaataaagatcgggccgcccagatattcgtgtaaatcacttccgcagatgccgcaccatttgactttgatctttacttttcccggctccgtttttggctcttcgatatgttcaatacggatatccttttggttatgccatcttgctgccttcatggattaccactcctataacttttgatgtgagtaattccgcaccggtcaatatgaactgttcacaaaatcgccatttttaaaaccaaaaaagaaatgaaatttttatataatataatctacgtttttttgaaaaaagaaactttgaagaaaaaagggtctcgcacactcttttttctttatatgagagtatcaatcgtttacatagctatgaatttggtttgaacaatacggtaatggttcgttcatattgaatgcgacaactactctatcaataattataacgctaatactgctattataataggataatcttccatggtttattttagcagaggtaacttttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataatggagtcgggaaaaaaggctcttcaggtaagaaacttggacattgggattgtgcgaccaaaatcggatttgatgttcctagaaacgggacaaaaatcagagcttatgcaaaagcgaagcctaaaaaggtgattacggtttataaaaatgatgttggcagaatgcctaatgcagtgctggatgttagccctaaagcgtttaaagcgcttggatatccattaagcaaaggtaaagtagctgggcattacagctattaatgtacatatataatctggaaagcaagaagtcacattcttgctttttctattggtggagataaaagatgaaaaaaagaatcatattattgttagcagtgataatagcggcagctgccgcgggggttgcgttttatgttacaaaggataaaggccatgagaaggctgctgatgtttcagtcaataccgaaagcggtgatgagctgctggtttcaattacagatacggatctgctgacaaagtattatgaaaatgacaaggtgatccatgaggagaagctgaccagctatccggcatttgccttggatcaaaaacagcaggtgctctattatacgggcaataatgaacagaatgaaatgaggctttttaaattggatctgaagtctcataaaaaaacgatgctttataaaggcgcggagagtgcggacagtttatttttatcaaaggaccgttcaaccatctatttccgcttaggaaaagcggacgaaagcaattttcggatcgccgcttttgatctgaagacgaaaaagtataaaaatctttatcctgccgctaatgatcaggatgacaccgtcagcagcttcttttataaccaaaaaaacgattcatttgcattgcttcattattctgtagaagaagactacaagaaaacagatgaagcaaacgaaaagggcatcgacccagaaccgacaacgattcattttgcggaaggccgccaacataaatttaatgagctgaaaagcctaaaccaatttatcagcgatattgctgtttctgatgatgataaacgtattttattcacatcatatacgcaaaaaggaacggagcaaaccgcttctattcaaatgctcaatgcggatacgaaaaaatatgaaagcatcatctcaaatcaaaaatcatttaagctgttaattgacgcacagcctcagttctctaaggatggaaagaacatttattttcttgccgaagccaagggggctaaaaaactgaaggatgaaacagggcgtgaagctaaggtgcggacgatttattcctatagccttgaaaataagaccttcaaaaaagtatggaaaaatccgaacggcatcatcaacagcttttctgtgattaactaataaaaaccactcggcataagctgagtggcttttttaatggatgaggtgcagggctaatgatccgagccatttaaagatatgaatcagaggtaccgacaaaaacagaagttcaacatacgagttcattgcaacattcagctttttgaacgcagctctttttttcaagtctttttgctgctggtttgagatcacgttatcactcctcttatatccatattataccattaaaacagacaaaaaagccctaaacgtttacagttttgggcttctttcttcgtatttggcctcttgcaatgagaggcttttattctgaaatatagaattttgtctccgttcggggtttgtttgcttgcaggagactgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacatttcttattgtctcatacttttccctaatctcctaattcctttttctttatgactttccaataaccccatctaaaaaggagaggagtgtgctgttaaaagcatctggctcttctaaaaacgggcaatggctgcttttagaaaaggtaacgagtgtcgcgtttggaatattgctgcgcaagtgttctccagctgctgtagagaaaaatttcttgtcttccccgaagcacagcaatgtcggcacattgatgttttggagggtgctccggtaatcagcggccgtttggttaaataaaatcgtgctagaaatggcagccggctgtttgaggatttctgccagcatccattctgtttcggtctcggcaggcggttctgcgaacatattctggatgaagctttcgtagaaaggcagcgggtcagtttgaatggcgtgcatcgctgtttttaagccgttaaaatcaaatggaccgtgttcccagccctcccattgatagtcggaagcggattgatcgatgatcacagcggcttgaatgttatcattcccaaattgattgagataatcccatacgacaaaagcgcccattgaccagctggcaagaacgacatgatcaagctccattacatttagaaattcccttatgtcacgggcatattgggaaatggtgtggccgtgaagcactttgtcagattcgccgtgtcctctaagatcaagacgaatacattgataattggcagaaagcgccgaaaattgtttgtggaaaaattgtccgctcatcagcaccccatgtataaacaggatcggcgtcccgctcccgtgtgtttcatagtaaaggcgtgtctgatcttctaatgtgatgtatggcatgtttctcctcctttagtttccatcatgagtatggctggctgctgttgagctgatgatggcagctgtcgcggctgcctgctgcgcttgaatgactgtttcgatagaggtgtatagtcctgattccatcagcagatttttctccatatgctcactgagatagaggctgacagcaattttaaaattcatttccttttgccgtttaaaagctttttcctggtttaattcgtcagtgatgcacaaaacggttttgatatctggctcttccagaaatgtgaggagagcaaggtctggataatgataatcctttggttttttgacagattcagtgatcgattgatatatctgtttgcaagcggaaacaagcatttcgggctctttttcactttgcaaggccagaatatggctgacctgatgtaagtactgtccttttttaaagccgttggctgccagcagctgatagcatgtttccgccttctgtagcgcctgcaaaccttctccgttttctccaagcagtacggcaagcggaacattctgagttgaagtgaggaaataatgatttttcttcatctgctgataaactgctagccccatgttcatctgttctttttggtttgtcgtttcagatttgccggtgagcaagattagagcggaaaggtatgtgaacatatcccgcttgtatcctagcttcaccatttcattgtatacatcgataaaagtatgaaatgtttgttttgcctcatgctgaaaatgaatgtccagaatagatgcaatagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttggttttaattcagcataaatggaaatgtattgctttattttttcatgtaggttgtgtgtcagcataaaaagcagctcctttttgctgtttttacgtaatacgataaatagggccaaaggtttcataaagaaaaaacttgcctgctagaggcaagtttgtcgggttatttatggggatctgttatatccatcggtctcatcatgtcatagtcttcatgctccagaatatggcaatgccatacgtatcgtccgctgtacggaccgaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtgaatcggatgtgttccgcgtgttgggttgataatggaccatatttcagttgtgccgacttttggtgcttctgtgacgggatcgtgccagcgtttgttattaagcagaaggacgggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattcgcatctgtttcaggattgacgtcaccgccgcagcccgcgctgtttgccaaaatgatcgattctccttcatacgctgtgaagtcaatgatgatatcataacgttcagcaggcgcaaggctgaaagaattcagtttaacagatcgcggcaggagccctccatctgaaccaatctgaataaactctccgccattatcgagtgacaggttataggttcttgtattggaggcgttgatgacacggaatcggtatttccttggctcgacttccaagtatggccataccttcccgttgacgagtatggtttctccgcaaaaagccggaacgattgagggattaggcagtgacggagaagggttttccggtgcgctcggataaaacaaagaaccgtcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtgataccacaatatagccccgcgctgctggtttggataatgataaacctctcttttgaaataaggtcctgtttgttcaaagtctttggaaaaccaagcctcgggatacccgtcactgtcatctggcgtgacaccgccgtgtaaatgaacaacagtctttacctcgggctcttcatgctggctgtcactgtgatgaatggtgtgatcaatcggaaggaaatgcgtggaaggtaggttattcatccattttacatatacgttttcatttcttttaacctcaatggtcggccccggaaataagccgttgtagccccacaggcgggttgggggagatcgcgatggagctgatgggtgcattcctccatggtgacttcgtagtatgttttttcttttgattgctgtactggctttagtgtatctgggattgggagagcatccacaaatttttcaagtgtcattttcatctgtccttatctaaattttccaaattggtattatagttaatgacaataaggacgtgatggttacaaaaaatcttcgtgctgcagactgcccgagaaagaaaataacaaaatcctaaacggctggccgtttaggatttgatcagcattaaggcaggatatcgggctgctgctgtgtgactgggttggcagccgctttctcgctcaccttgcgttttctgaacacaaggtaagaaatcagaacgattcccgtgatgacgcctgtaagcagcagctcgtctctcatggaatcaataaacgccatggacactaaaattccgcaaatggcgatgatggtcaagtaggttaggaaagggaagagccacattttgatcttcaatgcttctgggtttgttttttcgagttttttccgcattttcagctgggaaacagcgatgacaagatagacgagtaaagcgattgcgcctgatgagttgactaagaataaaaagacggtatccggtgaaaaatagttcattacgaccgcgatataagagaaaaatgtcccggccacaatggcttgtacgggaacgccttttttgctcaatttcataaaacggcgcggcgcttcgtttctttctgcaagagaatacagcattctggatgtggtgtacaaacctgaattcaggcaagagagtacggctgtgaggacgataaaattcataatctgtgcggctgcgggcactcctatatgctcaagtacagcgacgaaagggctttctaaaatatttgctgaattccatggcaacagcgctacgacaatggcgattgagcccacgtaaaagacgatgatgcgccatacaacggatctggtggcttttgtcacagattcgatcgggttggatgtttcccctgctgcaatggcaacgatttcagttcccataaaagagaagatgacaacgacaatgccgagcaatacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgcgatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagattggttcataagttacctccttttaaaatgcaatcattactgaatattatgataattgaaactctatcataaatatacagtttgtcgaaaattcatgtgagaaaatataacgttttatttcaaatttgtagtgttttgtttgcgctttcagcgaatgtgtggaaaaaatgtttcgttttttatttgctgtgtgattttgtgtactatttacaattcgatagaatgcgagaagcgctggtgtcattggatctgatgggctttttggcggagcaaataaattggatgagagaaaaagtgttccatcgtcactatttttctgtggcgggtgaatcatgtttctgtagacccactgcggatcagctttgtaagataataataggaaaatgtgagcggggaggaggttttgtatggagagatatgatgaactgaaaaagggagaatccggagcgctggtcagcattgccgcgtatctagttctttccgcaattaaactgatcatcggttatctttttcactcggaagcacttacggcagacgggttaaataacacaactgacattattgcttctgttgctgtgctgattggcctgcgcatctctcaaaagcctcctgacgaagatcatccatacggccactttcgagcggaaacgattgcatcgcttatcgcatcgtttattatgatggttgtcggcctgcaagtgctgttcagcgccggagaatctattttttctgctaaacaagagacgccggatatgattgcggcttggacggcagcgggcggggcagtcctgatgctgatcgtttaccggtacaataaaaggctggccaaaaaggtgaagagccaggcgctccttgctgcggctgctgataataaatccgacgcattcgtcagtatcggcacatttatcggcattgtagctgctcaattccatcttgcttggattgatacggtcactgcgtttgtgatcggtctgcttatttgcaagaccgcatgggatatctttaaagagtcatctcactctttgacagatggattcgacataaaggacatttccgcttataaacagacaatcgaaaaaatctccggtgtgagccgtttaaaagacataaaagcaagatacttgggcagtacggttcatgttgatgtggtggttgaggtatcggcagatttaaatattacggaaagccacgatatagccaatgaaattgagcggagaatgaaggaggagcatgcgattgattattcgcatgttcatatggagcctttagaacacaaataattgagcttcctgccacaggaagcttttttgtgtgttttggccagctttattggaaacaatttgctagaatcgtttttttatacagattgctttttgtggtaaagttaggttacattatgatgaattttgtagatgactaggaggaaaagaatggcatatcaagaagacctgcatcctttgctggggaaagcagttgaacatattaatagagtaatggttggaaaacgagacatcgccatactcagcttagcagcccttcttgccaaagggcatgtgctgcttgaggatgtacccggagtcggaaaaacgatgatggtccgcgcgctggcaaagtcaatcggcgctgatttcaaaagaatccaattcactccggatttgctgccatctgatgtaacaggggtatctatctataatgcgaaaacgatggaatttgaatatcgtcccggcccgattatgggaaatatcgtgctggccgatgaaatcaaccgtacctctccgaagacacagtcggctttgctcgaagcgatggaagaggggagcgtcacggtagatggccatacgatgcagcttgccgatccgttttttgtgatggcaacgcaaaacccggtcgaatatgaaggaacctatcctttgccggaagcccagcttgaccggtttttattcaaacttcggatgggttatccgtcctttaatgaagagcttgacgtcttatctcttcaggaaaaaagccatccgattgagacgcttgagccgattattgcaaaagaagacttcatccgtttacagcgggaagtgcaaaatgtccgtgctgatgacagcattaaggaatatatcgttgaaatcgtgcagaaaacgagacagcatccttctgttcaattaggcgtcagtccgcgcggctcaatcgccctcatgaaagcggcacaggcatacgcactgctgcatcatcgcgactatgtcataccggatgatattcaatatttagctcctttcacgctgccgcaccggatgatgcttcatcctgaggcaaaatttgaagggattcaggcagaagcgatcgtaagggagatcatgtcagctgtgaaggtgccggttcaaaggtcgtcggtccgctgatgaataagaaatggcaatggctcgtatatggttggaagctgattatattaactttattgacggctgctgttttttcttatgcgatgtttcagggcggctttgtcagctggtttttgttttacgcgtttctcccttttgtcttgtatgccgggctgctggccttgtatccgctccgttcttttcaggcttcaaggcaaatggatagaacacaattgcatgcgggggacaggctgggcgtaactgttacgctgagaagaaagctgccatttccgctgatgtatatggtgattgaagattgcctgccagaaggtatcgagtcattaaatcgagacggagccgcggccaaacggctcgtttttccttggtttaaacggagcatgacgatgtcctatgaattagctcgggtaccgcgcggagagcatcactttcattctgtcagggtgcgaaccggggatgttcttggcttgattgaaaaaacagcattttttgagctggatgacaccctgtttgtttatccatcctttcagcgtttttcctatcaggtgaatgagaggcatcaggaagacggtgtaagcggttcttctcctattcatcagcaccattcctcagtcgcagcaagtgtgcggaattatcagccgggagaccggtttgctgcgttagattggaagacctctgcacggcggagccagctgatgacgaaggaatttgagccttctcgcagcaaaaatctgtttctgctgatggaccgtttttcctcagacgcattcgaagaggtcgtttcagtgacagcttcgattcttcattctgttttaaaaaacggcgcgggtgctggtctggcttccatcgggaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgagctctctcaagctgaaaatgtcatgattgaacgcatgatgaaacgccaaatcagagttcgggtcatgaggggcgggcgagtttcgcgtgttgtttagaaagagaggtgactggttcacatgccgcacgatgatcacaagggaagccgtttgagcttgctgttattttattttctggcttttttattgctgtgggagtggctcaggccgcttgacagttttactgaaacgaaacatacaggcttttttagtgtctttatcggtttgacgtttctgctgacttttttcaggatgaggtggtttgtcaccgttcctttttgtgtcatatttacattgatctcgatacacatcctgttttatcaaggatctatattcgacttgagctgggtcagctcttttttgcaggatgtctatctgaatatcacgctgattcaatctgggcaatggaatgacatgattccttcatttcggaccctgctgttttttgtgctgctgtggctgctggtctatctcctgcattattgggtgatttaccagagaagaattttgtttttctttatgatgacagtagcgtatattacgattcttgatacctttacgccatatgatgccacttttgccgtcatccgtatcgtgctgatcggcttctttatgctgggccttttatacttggagcgcattaagctgatggaaagaatcacactgccaaaaacatctgtcctgaaatggtttcttcctttatctgtattggttttggctgcaacgggattcggactcgccgctccaaaatcagatccggcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggatacgtataccgggaaaggctggattgaaacagacacaggcatgtcgtatcagcttagcaatggaaaagttgaaaatctgtggtttgaccataaagttgcgacagagcgccgcaccgtccgtgtaaaagtcgataagcactacgggtataaccatctgatgtatccgattggtgcggaaaccattcagccaaagcaggctgtctcacttgaaatgaacggcaacacggagcaaatttctccgatcagtgaacaagccggcgaaatcagaaatatggggaattatactgtaacgtacaattccccggtctataagctggatgaactgagaaaggtaaaagtgagaaaaaacagtgaggagtacacattcagcgatcgctacatgcagcttccagattcacttccagagcgggtgagaacccttgcgatcaaactgactcaggatcacgacaatatgtttgataaggtgaaagcggttgaggactatttagggtcaaatgcgttcacatatgaaacagaaaacgtgaccattccgaagaatgatgaagattatgtcgatcaatttctctttgaaacgaaaatgggttattgtgataacttttcttccgccatggtggtgctcttgcgctcggccgggattccggcccgctgggtaaagggttatacgtccggcgaatacaaagaagcaggaaacaaaaatggcaacatctacgaagtgacaaataacaatgcccattcctgggtagaggtgtatttcccggaacagggctgggttacatttgagccgactaaagggtttacaaatccggctgaatttacttcttctgacacaaaggactccggcagcgataacagcagctcgccgaagaaagcaaaacagaaagaagagaaaaaacagccgcaaaaagaggaaaaacaaaaggaaaagcgggagccagctgtttctaaaaagccgtccgcttcgcataccaatgccggtgcgggcttgtatgcagcgcttgcggttcttgcagtcctcctggtggcagctgtattgctgtatgttttccgctcgttatggattcctgttttcgccgtgaggaaattgaagcggcgcagcgatcagcacgcgttttttgaggcatatggcgcgctgctgaaacaactgaagagaaaaggactgccgaaacgagacagtgaaacgctgcgtgattatgcaaaacgaatcgatgaaaaatacgacatagaagacatgtcaaagctgacattaagctatgaaagggcgctttacagaaatgaagattcttcggcgctatggaatgattcgagagagttatgggaaaatttaattaaaagaagatggtcttgaccacttatcgacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtatacagcgagctgcatccacatacattgacggctgaagaaattaaaaaaatgaatccaaaaggaattattttatccggcggtccaaacagtgtgtatgatgaaaattctttccgctgtgacgagaaaatcttcgagcttgatattcctgttttgggaatttgctacggcatgcagctgatgactcattaccttggcggtaaagttgaagcggcaagccagcgtgaatacggaaaagcaaacatccacatcgaaggcacacctgatttgttcagagatcttccgaatgaacaagtggtttggatgagccacggcgatttggttgtagaagttcctgaaggcttcactgttgacgcgacaagccatcactgcccgaactcagcaatgagcaaagcagacaaaaaatggtacggcgttcagttccacccggaagtgcgccactccgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccgtaaaggcgaagctgagggtgttatgaaaacattcagcgaaggctttaacatgaacgtgattaaagtagacgcacaagatcgattcttagataaactaaaaggcgtttctgatcctgagcaaaaacgcaaaatcatcggtaatgaattcatttacgtattcgatgatgaagcggacaagctcaaaggcatcgactaccttgcacaaggtacgctttacacagatatcatcgagagcggtacagcaacggcacaaacgatcaaatctcaccacaatgtcggcggacttcctgaagacatgcagtttgagctgatcgagccgttaaacacgctcttcaaagacgaagtgcgcgcgcttggcacagagctcggcattccggatgaaatcgtatggcgtcagccgttcccaggaccgggactcggaatccgcgttcttggcgaagtaacagaagaaaaacttgaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattacacaatcggaatccgtgccgttacatcaatcgacggcatgacatctgactgggcgcgtatcccgtgggatgtgcttgaagtcatttcgacacgtatcgtaaacgaagtgaagcacattaaccgcgtggtgtacgatattacaagtaagccgcctgcgacgattgagtgggaataagaatcaattaatggaaaccatctttttggcaattttgccgggaagatggttttatttgtttattacgaacaaaatccgattttgtgtgactattgttcgctttttgtattgttttttcaaaatgaagttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcgaactgaaatccgtctgtagtcaagcgtcccaaaatgtattggggcgttttttatttggcgttttcaggacagaataaatagcaaagagtgaagggagtcaaatagcttgaaaacgttttttcagtttgatgagctgggcaccagctatcgcaatgaaatcattggcggattaacgacttttttatctatggcatatattttgttcgtcaatccgattacgcttgctttggacagcgtgaaagattttccggaggcgctgagaattgaccagggtgcagtctttacggcgacagcgctggcgtctgcagcaggctgtatcttaatgggattaatagcgagatatccgattgccattgcgccgggtatgggtctgaacgcgttttttgcgttttctgttgtccttggtatgggtatttcatggcaggcagctttgtccggtgtttttatttcaggtcttattttcgttgctctttctttaacaggttttcgtgaaaaaatcatcaacgccattccgcctgagctgaaattggcagtcggtgcggggatcggcctgtttattacattcgttggcttacaaggctcaggaatcattactgcaaatccttctacgctcgtcacgatcggaaacattcacagcggacctgtgctgttaacgattttcggtgtgattgtcacggttattttaatggtgcttcgcgtgaacgcaggcgtgtttatcgggatgctattaacagcggtagccggcatgattttcggtttggttccggttccgactcaaattataggcagtgtgccaagccttgcgccgactttcggacaagcgtggattcacctcccggatattttctctgtacaaatgctgatcgttattttaacattcttgtttgtcggattttttgatacagctggtacacttgttgctgtggcaacacaagctggtttaatgaaggaaaacaaattgccgcgtgcgggccgtgcgcttttagctgattcatcttctattgtgatcggtgccgtgcttggtacatctacaacaacttcttacgtggaatcaagctcaggtgtcgctgcgggtgcccgttcaggatttgccgcaattgtaacagggattctctttttactggctacgtttttctctccgcttctatcagtcgttacgtcaaatgtaacagcgccggcgcttattatcgttggtgcattgatggtggcgccgcttggcaaaatcgcttgggataagttcgaagtggccgttcctgctttccttaccatgatcatgatgccgttaacgtacagcatcgcgactggtattgccatcggatttattttctatccgattacaatggtgtgcaaaggaaaagcaaaagaggttcacccaatcatgtacgggctgtttgtcgtatttatcctgtactttatcttcttaaaataagaattgaaaaaccagctgcaccggcagctggttttttgttgcaaaagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaagcagaaaccgcgccaggaacgcggtgaatcaactgttaaagacaagcttgcgtctgtttgggcagccatcaacagatattgcggttttgcgttctcgattttaaaatcaccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcggctgccgtattgggttcattgcttgtaccggtaattgctgtttcaatcctttggctgatctttgcgatcgtaaatatcccaatgctgacagtactgtttacggtgctgatcttgttttccatcttttttatcatcgcgctgtatgtacagcgtgtgtaccaggcggcacaagatgcaccaattgattatatctattgtgtatttgcagtggttgcgatagcgctgctgtttacggcagtgacttggccttttatttcggaatattttacggcgtcgctgattccgctttaatgaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtgcttcgccgagcaattaaccaaaagaagcaatttttaaaaaccaaattactgctctcggaattttatcaaggaagaggggaacagcttgctgactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaacgcataaaagcatgtcgaaatattttgcttaagcttacgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacagggctgagtctggtgctcgataacttagaccagattcaaaatgtgatcgcgtacgcgctcggttacggtcttggcgtaattgtcggcatgaaaatagaagaaaaattggcgcttggctatattatggtcaatgtgattacgaaggagctcgatcttgatcttccgaagcagctccgtgaaaaaggctacggcgtgacaaactgggtggcaggcgggcttgaaggcgaccgcacagcccttcagatcctgacgccgagaaaatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgattgatgcggtgcttcagcaaatgaaagaagaaggatatctgcctgtaaggcgaatggaagaacctatttttatggaaaaaaaggaaaatgggtcaattcagatcgttccgtgcgggaaaaaaatcgtatttgaagggaaattgatctaaaacacgaacattagtagaatgaatttttgtatcgttcgataatatcgttgacattatccatgtccgttgttaagataaacatgaaatcaaaacacgacctcatataatcttggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaaggccttgcccgtaagctggatgagagaagagaaaatacaaaacagacagtgttagaaagcagtgatcagcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtgaagcgattcgaaaattggctgaaatcagcgatatcatcacatatgagtttgaaaacatcgactatgatgcgctgcattggctaaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgaaacaggcggtacaggagctcgggttacccgcagttctgaagacatgtcgcggcgggtacgacggcaaaggccaatttgtgataaaagaagaggcgcaaatggagcaggcagccgctctgttagaacacggaacttgcattcttgaaagctgggtttcttttaaaatggaactgtcggtgatcgtcgttagatcggtaaacggtgaaatttcaacatttccgacagctgaaaacattcaccacaacaatattcttttccaaagcatcgtgcccgcacgggtagagaaagggattcagcagaaggctgctgatctcgcagttaagcttgcagatgagcttaaccttgtcggaccgcttgctgttgagatgttcctgacagaggacggagagcttttggtcaatgaactggcgccaagaccgcacaattctgggcattatacgctggacctttgcgagtcgaaccagtttgagcagcatatcagagcagtatgcgggcttccgcttgggaagacagatttgctgaagccgggcatgatggtgaatcttctcggcgatgaagtgaagcttgttgaggaagatccggagcttttaaaagaggcaaagctatatatatacggaaaacatgaaatcaaaaaaggccgcaaaatggggcatattacatttatgaagcagcctgaagacgaatggattcaggagatcacaaataaatggatgaatagagacggaggacaagcagaatgatcgaacgttattcaagacctgaaatgtccgcgatttggacggatgaaaacagatttcaagcatggctggaggtagagattcttgcctgtgaagcgtgggcggagcttggcgtcattccgaaagaagatgtaaaagttatgcgtgagaacgcatcatttgacatcaaccgcattttagaaatcgaacaggacacgcgccatgacgttgtcgcttttacgcgcgctgtatccgaatcactgggcgaagaaagaaaatgggtgcattacggcttaacgtcaactgacgttgttgatacggctctttcctacttattaaaacaggcaaacgatattttgctcaaggatcttgagagatttgttgacattattaaagaaaaagcgaaagaacataaatacacagtcatgatggggcgcacgcacggcgtacacgctgagcctacaactttcggcttaaaacttgcgctttggcatgaagaaatgaaacgtaatcttgagcgcttcaaacaagcgaaagcaggcatcgaggttggaaagatttctggcgctgtcggcacatatgcgaacattgatccatttgttgaacaatatgtctgtgagaagctcggattgaaagcagcaccgatttcaactcaaacccttcagcgtgaccgccatgctgactatatggcaacacttgctttgattgcgacaagcatcgagaaattcgctgtggaaatccgcggactgcaaaagagtgaaacacgtgaagtagaggaattttttgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggtcttatctattctcagcgtgtgctgcttgctttgattgacacaggcctgactcgtgaagaagcctatgatacagttcagccgaaagcaatggaagcgtgggaaaaacaagtgccgttccgcgagcttgttgaagcggaagagaaaatcacgtcacgtctttctccagaaaaaattgctgactgctttgattacaattaccatctgaaaaatgttgatctgatctttgaacgtttaggtttagcatagaagaagcttttagcggcttcttctaagccgccgcagtttgaaaattcccaacattcgggttaggaggccttccgtgaatattgtgaagaatgaacttttatacgaaggaaaagcaaaaaagatctacaaaaccgatgacgaaaacacgctgtatgtcgtgtataaagactccgccactgcctttaacggcgagaaaaaagcagaaatcagcgggaaagggcgcttaaataacgagatttcaagcttaattttcaaacaccttcatgcaaagggcattaacaatcattttatcgagcgcatttcggaaacggaacagctcattaaaaaggtaacgattgtgccgcttgaagtcgtggtcagaaatgttgtggcaggaagcatgtccaaacgtctcggcattccagaaggcacggagcttgagcagccgattatcgagttttactacaaggatgacgcgctgggtgatccgctcatcacagaagatcatatttggcttttgaaagcggcgactcctgagcaggtagaaaccattaagtccattacaaaaacagtaaatgaagagcttcaaagcattttcggcgattgtcatgtcagattaatagatttcaagcttgaattcggtttagatgcagaagggcaagtgcttttggcggatgaaatttctcctgacacatgccgcttgtgggataaagacacgaacgaaaagctggataaagatttattcagacgcaatctgggaagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttacaacgaagttcaagatgtgcgcatcgggaaatacatggagcttaccattgaaaaatctgaccgtgatcttgacgtgctagtgaaagaaatgtgcgaaaaacttcttgcgaacacagtgattgaagattacagatatgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggcgtgttaattccgggagggttttcttacggcgattacttaagatgcggcgccatcgcccgatttgcgaatattatgccagctgtcaaacaagcagcggctgaaggaaaacctgttcttggcgtctgcaacggattccagattttacaggagcttgggctgctgccaggcgcaatgagacgcaacaaagatctgaagttcatttgccgtccggttgaattaattgttcagaacgacgaaacattattcacagcttcctacgaaaagggacaatcgattacaatcccggttgcccacggtgaaggaaatttctattgtgatgacgagacgcttgcttcattaaaggaaaacaatcaaattgctttcacatacggatctaatatcaatggaagtgtcagcgacattgccggtgtcgtcaatgagaaaggcaacgtattaggcatgatgcctcatcctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactatatcagcaaatgggtgtcagtgatgatgagtttgcattgatagaatccattcttggaagattgccgaactacacagaaatcggaattttttctgtcatgtggtctgagcattgcagctacaaaaactcaaagccgattctgcgtaagttcccgacaagcggcgagcgtgtgctgcaggggcctggggaaggcgccggaatcgttgatatcggtgataaccaagcggttgtgttcaaaattgaatcacataaccacccatcagctctcgagccttaccaaggcgctgcgactggcgtaggcggaattatccgtgatgtattctcaatgggtgcacgtccaatcgctgtattgaactctcttcgatttggtgaactgacttcaccccgcgtgaagtacttgtttgaagaagtagtagcgggtatcgccggatacggcaactgtatcggcatcccgacagtcggcggagaagtgcagtttgacagcagctatgaaggaaatccgctcgtcaacgcaatgtgcgtcggtttaatcaaccatgaagacatcaaaaaaggccaggcaaagggtgtcggcaacacagtaatgtacgtaggagcgaaaacagggcgtgacggaatccacggcgctacgtttgcttctgaagaaatgtcagactcgtctgaagaaaagcgttctgctgtccaagtcggcgatccgtttatggagaagcttttgcttgaagcatgtctggaagtcatccaatgcgacgccttagtcggcattcaggatatgggagctgccggtttaacaagctcaagtgcagaaatggcaagtaaagccggttctggtattgaaatgaaccttgacctgattcctcagcgcgaaacaggcatgaccgcgtatgaaatgatgctttctgaatcacaagaacggatgcttttggttattgagcgcggacgtgagcaggaaatcatcgatatttttgacaagtatgatcttgaagcggtttctgtcggacatgtgacagatgataaaatgcttcgcctgacacacaaaggagaggttgtgtgcgagctgcctgttgatgccttggcagaagaagcaccggtttaccataagccttctcaagagcctgcttactatcgcgagtttttggaaacggacgttccggctccgcaaattgaagatgcgaatgaaacgctgaaggcccttcttcagcagccgacgattgcgagtaaagagtgggtttatgatcagtatgactacatggtgcgcacgaatacagttgtcgctcctgggtctgatgctggtgttctcagaatccgcggaacgaaaaaggcgctggcgatgacgacagactgtaacgcgcgttatctctatctcgatcctgaagtcggcgggaaaattgctgtcgctgaagcagcgcgcaacatcatttgctcaggcgcagaaccgcttgcggtcacagataaccttaacttcggaaacccggagaagccggaaatcttctggcagatcgaaaaagcggcagacggcataagcgaagcgtgcaatgttctcagcacaccggttatcggcggtaacgtatcgctttataacgaatcaaacggcacggcgatctatccgacaccagttatcggaatggtcggcttaattgaagatacagcacacattacaacacagcatttcaaacaagcgggagatctcgtatatgtgatcggtgaaacaaaaccagagtttgccggaagcgagctgcaaaaaatgacagaaggccgtatttacggcaaagccccgcaaatcgatcttgatgtagagctgtctcgtcaaaaagcactgcttgacgcgattaaaaaaggcttcgttcaatctgcgcatgatgtgtctgaaggcggcttaggcgtagcgattgcggaaagtgtcatgacgacggaaaaccttggcgctaatgtgactgtagaaggggaagcggcattattattctctgaatctcaatcccgcttcgtcgtttcagtgaaaaaagaacatcaagaagcgtttgaagcaactgtcaaagatgcggttcatattggtgaggtaacagctgacggaattctggcgattcaaaaccaagatggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcagatcacgtattacggtctccacagccttcagcaccgaggacaggagggtgcgggcatcgtagcgactgacggtgaaaagctgacggctcacaaaggccaaggtctgatcactgaagtatttcaaaatggcgaactcagcaaagtaaagggaaaaggcgctatcgggcacgttcggtacgcaacggctggaggcggcggatacgaaaatgtacagccgctcctcttccgttcccaaaacaacggcagcctggcgcttgctcataacggaaaccttgtcaacgccactcagctgaagcagcagctcgaaaatcaagggagcatttttcaaacctcttcggatacagaggttttggcccatctgatcaaaagaagcggccacttcacactgaaggatcaaattaaaaactcgctttccatgctgaaaggcgcctacgcgttcctgatcatgaccgaaaccgaaatgattgtcgcgcttgacccgaacgggcttagaccgctgtcgatcggcatgatgggcgacgcttatgtggtcgcatcagaaacatgcgcatttgacgtcgtcggcgcaacgtaccttcgcgaggtagagccgggggaaatgctgatcattaatgatgaaggcatgaaatcagagcgtttttccatgaatatcaatcgttccatttgcagcatggagtacatttatttctccagaccagacagcaatattgacggtattaatgtgcacagtgcccgtaaaaaccttgggaaaatgctggctcaggaatccgcagttgaagctgacgtcgtaactggggttccggattccagtatttctgcggcgatcggctatgcagaggcaacaggcattccgtatgagctgggcttaatcaaaaaccgctatgtcggcagaacatttattcagccctcccaggctctgcgtgagcaaggcgttagaatgaagctgtctgcggtgcgcggggttgtagaaggcaaacgcgtcgtgatggtggatgactctatcgtacgcggaacaactagccgccggattgtcacgatgcttagagaagcgggtgcgacagaggtgcatgtgaaaatcagttcaccgccgatcgctcatccgtgcttttacggcattgatacttccacacatgaagaattaatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataaaacttgaaaaatgacataaaggcagcgcagttaggctgcctttctctttctgccctctttcggggagatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggacgctgttgcaatgtgtgtcaatgacgtgctggcacaaggtgcagagccgctgtttttcctcgattatttagcggtcggcaaagcggacccagtgaaaattgaacagattgtacaaggtgtggcggaaggctgtgagcagtcaggttcagccttagtcggcggtgaaacggctgaaatgccgggactctatacagttgatgaatacgatattgccggtttctcagtcggagtggcagaaaaggacgaaatcgtgactggagaaaacatcgaagagggccatcttttgatcggcctcagctccagcggccttcacagcaacggattttcccttgtcagaaaagtgcttctggatgatgcggagctggaccttgatacaacatatgagccgtttgaacgcccgcttggcgaggaattgcttgaaccgacaaggatttacgtgaagcctgtgcttgccgcggtcaaaagcggaaaaatcgacggcatggcgcacgtgacaggcggaggatttatagaaaatattccgcgtatgcttccggaaggcttaagtgcggaaattgatcatggctcatggccgatcccgccaattttttctttcttgcaagagtacggcaagctaaaggaagaagacatgttcaacgtctttaatatgggtatcggttttgttttggcagtcaaagaagagcatctgacagatgtgatcggaacgcttgaaagccatggcgaaaaagcctatttaattgggcgtgtgaaaaaaggtgaaggcgtcacattcggcggtgcggcactttcatgaaaaagtttgcggtatttgcatcaggaaacggttcaaacttcgaagccatcgtcacgcgtttgaaggaggagaactgggatgcgtcagcagcgctcctcgtttgcgacaaaccgcaggcgaaagtcatcgaacgggcggaagcattccacattccatccttcgcatttgagccgaagtcttatgaaaacaaggctgcatttgaaaaagccatcattgaacagcttcgccttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcataccgggcgggtgtgaaggtggccggaatcaccgtgcattatgtcgatgaaggaatggatacaggtccgatcatcgctcaaaaggcaatcgaaattgatgaacatgatacattggaaacaatcgaacagcgaattcacaagcttgagcataaatggtatccgagtgtgattaaacagctattaggattaaataacagaggtgaaaaggcatgaccattaaacgtgcattaatcagtgtttcagataaaacaaatctcgttcctttcgtaaaagaactgacagagcttggcgttgaagtcatctccacaggcggaacgaaaaagctgcttcaagaaaacggtgtagatgtgatcggaatttctgaagtgacaggctttcctgaaattatggacggccggttaaaaacccttcacccgaatattcacggcggtcttctggcggttcgcggcaatgaagagcatatggcgcagatcaataaacacgggattcagccgattgacctcgttgtcgtcaacctctatccatttaaagaaacgatttctaaagaagacgtcacgtatgaagaagcgatcgaaaatatcgacatcggcggacctggcatgctgcgtgcggcatcaaagaaccatcaggatgtcacggttatcgtcgatccggccgattacagcccagtgctaaatcaaatcaaagaagaaggcagcgtatctcttcagaaaaaacgcgagctcgcggcaaaagtattccgtcatactgcggcatatgatgcactgatcgctgactacctgacaaatgttgtcggtgaaaaagaaccagagcaattcactgtgacatttgagaaaaaacaatcgcttcgctatggagaaaacccgcatcaggaagcaactttctatcaaacagctcttcctgtcaaaggctctattgcgcaagcagaacagcttcacggaaaagagctttcttacaacaatattaaagacgcggatgcggcagttcaaatcgttcgtgaattcactgagccggctgctgttgctgtaaagcatatgaatccgtgcggtgtaggaacaggaaaaacgatcgccgaagcgtttgacagagcgtttgaagcggataaaacatctatcttcggcggcattatcgcgctgaaccgtgaagtggacaaggcaactgccgaagcgcttcacaacattttcttagaaatcatcattgcaccttcattcagccaagaagcgctcgacgtcctgactgcgaagaaaaatctccgtctgctgacgcttgacgtatccgccgctgttcaaaaggaaaaacagctgacatctgttcaaggcgggctgctgattcaagatttagatatgcacggcttcgttgatgctgagattagcattccgacaaaaagagaaccgaacgagcaagagtgggaagacttgaagcttgcttggaaagtcgtgaaacatgtgaaatcaaatgcgatagttctcgcgaaggacaacatgacagtcggcgtgggagcaggccaaatgaaccgcgtcggatcggcaaaaatcgcaatcgagcaagcaggggaaaaagcgaagggcagcgcgctcggttcggatgcatatttcccaatgccagatactgttgaagaagcggcaaaagcgggcgttacagccatcattcagccaggcggatcgatccgtgatgaggattctatcaaaaaagcggatgaatacggcattgccatggtattcaccggcatcagacacttcaaacattaaggggatgaaaacgacgtgaatgtattaattatcggtaaaggcggaagagagcatacgctggcgtggaaggcggcgcaaagcagcctcgtcgagaatgtatttgccgctcccggaaatgacggcatggcagcttctgcacagcttgtaaacattgaggagagcgaccacgcagggcttgtctcatttgcaaaagaaaaccaggtcggcctgaccattgtcggccctgaggttcctttaattgaaggtctggtggatgaattcgaaaaagcgggcttacgtgtgttcggcccgtcaaaagccgcggcgatcatcgaaggaagcaaacagttcgctaaggatttaatgaagaaatacgacattccgaccgcagaatacgacacgtttacatcctttgaagaggcgaaggcatatgtgcaggaaaaaggtgctccgattgtgataaaagcagatggacttgcagctggaaaaggcgttactgtggctatgacagaggaagaagcaattgcgtgtctgcatgactttcttgaagatgaaaagttcggtgatgcgagcgcgtccgttgtcattgaagaatatctttctggtgaagaattttctctgatggcctttgtcaaaggggaaaaggtgtatccgatggtgattgcccaggatcacaagcgtgcgtttgacggagacaaaggcccgaatacgggcggaatgggcgcttactctccagttccgcaaatttcggaagaaacggttcgccatgctgtagaaacgatcgttaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtacaggtgcttcttgatcttttagatgataaggaagttgacttaagatggaaggataccgcggcagtgagtgttgtgcttgcatcagaagggtatccggaaagctacgcaaaaggcacgccgatcggcagccttgcagcagaaactgagcaggtcgtggtcttccatgccggaacgaaagcagaaggcggagagtttgttacaaacggggggcgcgtcgccaatgtgacagcttttgatgaatcgtttgaagcggctagagaccgagtgtacaaagcggttgatgaaatattcaaaccgggactctttttcagaaaagatattggggcacgcgctttaaaggctgcccaaaaataagtgaggaaaacccgcagattagctgcgggttttttgttatcaaaaagcgggatggcagctagaagaagaaagcacaacgagcgtggttggttttccatgggccatcgaggcgtcaataaaatcctcaagcgtatgtaccgattcagtcacgacctttgtcacatagctgtacatccccgtgatgcggtggttttctgctacatcaggatgcgatgttgcaaaggcggcgtagtgcttgcagcttttcggctccatgagaataaaagcggtgacatgcttgtttagtttttcgtaacagatattcgcgctgtagccggtaatcactcctttgtcttccagcttcctgacacgctccgccgcgcttggcgagctgagtccgacaagctttcccagctcaaccatcgttaatctgccgtttcgctgcaaatgcgagagaatctgaaggtctgtatcgtccatttgtctggctcctttacatatttaggcgaatgaatgaaaattcctttgatcgtaaggtaatgctgttgatttaacttcattgtagcatatggatgtcgtcttattttttctataataaagccatcaatcagagagggggcatcatgttgccagaattacagcgctctattacttggatacaagggacggcgttaacgattggggcggttttaggatgcgggatattaatcctgccgtctgtcaccgcggacacggccggtccggcttctttatttgtctgggtattcatgtcttttttatcttttcttcttgtcggcacgctggcccggcttgtgaaaatagcgcccatcgcgggaggaatcacggcttatgtgcagctggcctttcagaaaaaagccggggctattttgggctggatcatgttagggtccgttccgatcggcgttcccatcatcgctttgactggcgcgcattacgtcagttacatcacagaggcggccgattggcagattacattgattgctggttgcatgctggctatatctattttgcttcatatgagagggattcaactatcagcaaacattagtacacttgttatatgtgtcatcgtatttctgcttgtcacttctattgctgtgtcattgccacacgtcacgatagcagaattcaagccgtttcttccgcatggctggtctgctgctggatctgtttctgttatgatttttttctcttttgtaggctgggaaatgattaccccattggctgaggaatttcatcgtcctgaaaaagatgtcccgctcagcttgtttttggcagcgtcttgtgtggcgggactgtatatcatgctgtcatttgtgaccgtgggtactcattcatatggagagaatggagaaattgcatcgcttgccatgctcatctcaaaaggagcaggggaaagcggtgtatacgtcacggtatgtttagcgctgtttattacattcgctaccatccatgccaatattgctggtttttcaagaatggtgtacgcattggcgagagaggggcacatacccgtattttttggaaaactcagtgcgacaaaacgtacgcctattcgcgttttgacagcgatggccgcggtgtttggcttagtgcttgcagcgcatggcgtctttcaaatcgatttgacgactctgttgaaagggccgagcgcggcttttatcgcatcttacatatgtacattggcggcagcactgaaactcctgagctggagagattcaggctggtggatggcgctcggggcgtttgtggcgtgcgcggtgatttactcattcagcggctgggcgcttctttatccggcagtgctggcagctgcaggatatttctatataaaaacaaagggtgggcataaaaaaaagcttgatcacgttttgtgatcaagcttttccatttatccgttttgaggctcgttatttccagaatcactgtgttgaaacatgtaggtcacaggacagaagcgcaagattcccgaacccgctttcatggcccccataaagatgtaaaagagatgcattctgcaccaaggttttttcgtaaactttgcactggcggctgacataatcgtcaatccgcaggcgattctgaacacggcattgatgagactgatgtttggcttcaaggaaatccgctccttttacttaaaaaagttttttaatcgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccggatagagccgaagaaattcatacgattgattgtgaaggaaaatacattgtgccaggttatattgaaccgcacgcacatccttttcaaatatataatccccaaacactggcggaatatgtgtctcaatatggaacaacgacattcgtgaatgataacttatttttgcttttgcaaagcggaaaaaagaaagcgcttacgattttgaatgaactcaaaaagcagcctgtccagtatttttggtggtcacgctatgacctccagaccgaggttctgaacgaggaccacgtccttccatttgacgtcagaaaacagtggattgaacatccggatgtgattcaaggcggagaaatgaccggatggcctcgcctggtagatggtgatgatttaatgctccactgcatgcaagctacaaagaaacagagaaaacgcattgaagggcattttcccggcgcttctgataaaacgcttacaaaaatgaagctgttcggtgcggattgtgatcatgaagcgatgacaggtgatgaagtgatgagaaggctggaactgggctattatgtttcccttcggaactcttccattcgccctgatgtaagaaaaatcttgcaagaactgcatgagaagggcttccgctattatgaccacttcttttacacgacagatggcgcaacccgaatttctataaaggcggcatgacaaacgagctgattcgcatcgcgttagaagaaggcgtacctgcaatcgacgcctacaatatggcatcatttaatatcgcaaagtattaccaaatggatgattatttaggagttgtcggaccgggtagactggcatcgctcaacatactggaagatctgttaaatccgaatcccgtgactgttctgtcaaaagggactattctgcgtgaagacggctgtgatttgaaggcgtttacaaagacggactggcacaaaggcggtcttgtcccgcttgagctttcatatgatatgacgatggatgacttgcagttttctatgccgatgggcgtgaaaatgcggaatgcggttattatggagccatatatgattgagatcgacaattcgatggaacagctctcgtttgaccatgatgaaagttatttgttgatgctcgacagacacgggaaatggcgcgtcaatacgatgataaaagggtttgcctcaagcgtgcagggatttgtaagctcctttacgacgacgggcgacattgtcgcgattggaaaaaataaagcagatatgctgctcgctttcgcccgcatgaaagaaatcggaggaggaattgttttagcggagaacggaaacattctgcatgaaatcccgcttgcgctgtgcggctgcgcctcttcggaagcgtatgaagacgtgcttgagaaggaacaaaagctgagagatcttttgactgaaagaggctatgagttttgcgatcctatctatacgctgctctttttgcaaagtacgcaccttccgtatatacgtattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagactgaacagaaggtgactgaacgccggcctgttgctgttgtggtgaacaatcacccgaaggcgaggccgcagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaagagcagctggaatccggagctgccgattatatgaacggattggattttgacggaagcttattttggagagctgatttcagcaaaccgccccacaattcctatacgtcttatgattacataaaaaaggcggcggaacaaaaaggttataagctgaagcaggaaacaaatccgctgctgtttcaaacatcagatgcaaaacctgcaaatgaatcttacaatgttcgggtagattatggaacaaaaaacgttacaaatcttgtcgaatacaactatgataaaaaagctgaatcttatacaagaagctctgatggtgtcataacgacagaccgggaaaccggaaagccggttgcaatgcaaaatattttcattgttgaagccagccatcatattattgatcaagatggaaggcgggacatcgacttggaatcagggggaaaaggtctgttgtttcagcacggaaacgtcattgaaacagactggaaacaagtgaatggcagaattgtgccggtaaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacggaaatgacgcttatgaaatggcgcttgaccgtgtgaaggaaacggaaactgagtcttcttcaaaataacatagaaccgccctgccgttcggcaagggcggtttctttatgaaacaaattgatggatcaggttgtcgatatcgatgagactgccatcctctttccgatagacaacatgctccttggaaaaatgaatcggcgaattgatccctgctgcggctgcaaggttaaacagcccctcgcgcagggaaataacgtagttgcagacacgatgctgtttttcctcaacgctcaacgctttttgcaatttcggatctgtcgtcgccacacctgccggacaggtgttggtgtggcagacgagagcgcggatgcagccaacggaaaacatcatgccgcgtgcgatgttgacaaagtcagcgccgagggctaaggcgaccgcgattttatcaggagtcaggagctttccggaagcaaagattttcagctggctgcgcaagccgtactgtttaagaagcgtgtcaacaataggcagcgctgtcataattggaaggccgactgtatccgcgagctcgtaaaaggaagctccggtaccgccttcacttccgtcgatcgtgataaaatccggatgctttccgcttttctgcatataagagaaaagctcatgcaattcttcaggatgccctgcgaccagtttgatgccgactggcttttgtccgacatctctaagtttttcaataaagtcgagcatttcaggagggttcgagaattcataaaagcggttcgggctgtcaatcgactttccaggttcgacattccgaatgtctgccacttcctctgatactttggcgccgtccacatggccgccgcgggttttcgctccttgtgccagctttagctcaaacgctttaatctggtcaatccagctttttcttttaaattcctcccacgaaaattccccgtttcttttgcgtacgccgaataggcccggtccgatttggcaaatgatatcggcgccgccctttaagtgatactcagacaatcctccttcacctgtattcatccaggttccgcctgcctgatgaagcccttttgagagcgccgtaacagcccgttctccaagagaaccgtagctcatggctgactggccgactaagcccttcacataaaatggcttctcgcatgtatgctcgccaatcacctgcacatcatcaggatggagaaagtacgggtctgccttgatatgttcggcatgctccttgcgtttgaacagattgtcagcatccattttatagatttgggtttcaatttttggcgtttgatttacatgcatttcttccctttgttttggaaacatagcgttacggatataatagccaggtttatcaaaatctcttacagatccaaagcccatcattctgcttttgtatttgccggagatgacggtttgctcatattcctttcgagaaaaaggctgctcctcattgtcattgctgtataaatactgcctcagctccggcccgattttttcaaggatataccgaaaccttccgatgacgggatagttgcgaagaattgagtgctcctgctgtttttcatcctttatgtagatccaggcaaacaagacgatcgggatagcgatgatcccaatgataaatgcgatgagtgctattatgatggtttccatctctcagcctccctttttatgtaaccatttccacagtagaacactttccaaacaatagcagaaggaatctggtgaaaatgtgtgcttctgccggtacaggactcaccatgcaggtctgcctcctgctctctttttttatgaaaaaagaatcaaaacacctttttcagtgaataacgagattaacggctttttccgtttttccgcgctatgtgaatttgttataatgtttaaatggtaacaaacgaatggaggaacgtatgacgtgtacgatgtaactgagtggaagcatgtctttaaactcgatccaaataaagatttgcctgacgaacagctggagattctttgcgaatcaggaacggatgcggtcattatcggaggcagtgatggtgtgacagaggataatgtcctgcggatgatgtctaaggtaagacggtttctggtgccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtagcctatgcgcgtgtgtcggagctgctgcaactgccgattttttatttagaatacagcggcgtgcttggagacatagaagctgtcaagaaaacgaaggctgtattggaaacgtcaaccttgttttatggcggcggcatcaaggatgcggaaacggccaagcagtacgcagagcatgcggacgtgatcgttgtaggcaatgcggtgtatgaagattttgacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggcctcttttgctgatggcgggagcgggaagcggaaagacgcgtgtcctgacccatagaattgcttatttaatggcagaaaagcatgtggcgccgtggaacattctggcgatcacatttacaaataaagcggcacgcgaaatgaaagaacgtgtggaaagcatccttggacccggcgcggacgatatctggatttccacattccacagcatgtgcgtgcggatcttgcgcagagatatcgaccggatcgggatcaaccgaaatttctccattcttgatacggcggaccagctttcagtgatcaaggggattttgaaggagcgcaatcttgatccgaagaagtttgacccgagaagcatcctcggcacgatcagcagtgcaaaaaacgaattgaccgaaccggaggaattctctaaagttgctggcggctactacgatcaggtggtcagcgatgtatatgctgattatcagaagaagctattgaaaaaccagtcgctcgattttgacgatttgattatgacgacgattaaactgtttgaccgagtgccggaagtgcttgaattttatcagcgcaaattccagtacattcacgttgatgagtatcaggatacgaacagggcgcaatacatgctcgttaagcagcttgccgagcgtttccagaacctttgcgttgtgggggattctgatcagtcaatctacagatggcgcggcgcggatatcaccaacatcctttcatttgaaaaagattatccgaatgcaagcgtgattttgctagaacaaaactatcgttcaacgaaacggattttgcgcgcggcaaacgaggtcattaaaaacaactctaaccgcaaaccgaaaaatttgtggacggaaaacgatgaaggcatcaaaatttcctattatcgcggtgataatgagttcggtgaaggacagtttgtggccggcaaaattcatcagcttcacagctcaggcaagcggaagctgtctgatatcgccattttataccggacaaacgcgcagtcccgtgtgattgaggaaacgcttctcaaagcgggtttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggtttgtcatttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcgttaatcgcagatattgatcagctcgatcagaaggaggaagagtcaggcggcaaggatgcgatcacgctgatgacactgcacgccgcgaaaggactggagttcccggttgttttcttgatggggcttgaagaaggggtcttcccgcacagccgttcactcatggaggaagcggaaatggaagaagaacgccgccttgcgtacgttgggattacaagggcggaacaggagctttatctgaccaatgctaaaatgcgcaccttgtttggccggacaaatatgaacccggaatctcgcttcattgctgaaataccggatgatttattggaaaacctaaatgagaaaaaagaaacaagagcgacgtctgcgagaaaaatgcagccgagacgcggccctgtttcacgcccggtatcctacgccagcaaaacaggcggcgacaccttgaactgggcagtcggagataaggcgggccataaaaaatggggaacaggaactgtcgtcagcgtaaaaggcgaaggagaagggacggagctcgatattgccttcccgagccctgtcggcgtgaaacgcctgttagcagcatttgctcctattgaaaagcagtaattgaagaggaaaggaagaagcagatggacaaagaaacagcgaagcagcgggcagaagaactgcgccgcaccatcaacaagtatagctatgaatattacaccttagatgaaccgagcgtcccagatgccgaatacgacagattgatgcaggagctgattgcgatcgaggatgagcacccagacctcagaacgcctgactctcctacgcagcgcgtcggcggagccgtgcttgaagcgtttcaaaaagtcacccacggcacaccgatgctcagtctgggcaacgcctttaatgctgatgatcttcgtgatttcgaccgccgtgtgcgccaagccgtcggtgacgatgtggcgtataatgtggagctgaaaatagacggtcttgctgtttctctccgttatgaagacggctattttgtcagaggagccacccggggtgacggaacgacgggagaggatatcacggagaatctgaagacgattcgcaatatccccctcaaaatgaaccgtgagctgtcgatcgaagtgcgcggcgaggcgtatatgccgaagcgttcgtttgaagcactcaatgaggaacggattaaaaatgaggaagaaccgttcgctaatccgcgaaatgccgcggccggatcactcaggcagctcgatccgaaaattgcagcgaaacgaaacctcgatatcttcgtctacagtatagcggagcttgacgagatgggtgtagagacgcaaagccaagggcttgattttctcgacgaactcggatttaaaacgaatcaggaacgaaaaaaatgcggcagcatagaagaagtcatagtgctggtcgatgagtttcaggcgaagcgcgctgacctgccgtatgaaatagacggcattgtcattaaagtcgattctctcgatcaacaggaggagctcggttttacggcgaaaagcccgcgctgggccatcgcgtataagtttcctgctgaagaggtcgtgacgaagcttctcgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgtcgtcaaaaaagcgggcgatatcatcccggaagttgtgaatgtcctcgttgaacagcgcacaggagaagaaaaggaattcagcatgccgacggaatgtcctgaatgcggcagtgagctcgtccggatcgaaggagaagtggcgcttcgctgcattaatcctgaatgtccggcgcaaatccgggaagggctgatccatttcgtttcccgcaatgccatgaacattgacgggctcggcgaacgagtgatcacacagctgtttgaggaaaaccttgtccgcaatgtagcagatttatataagctgacgaaggaacgagtcatccagctcgagcgcatgggtgaaaagtccactgaaaacctgatcagctccatccaaaaatcaaaagaaaattcgttagagcgcctgctgtttgggcttggcatccgttttatcggatcaaaggccgcaaagacgcttgccatgcattttgaaagcttggagaacctgaaaaaagcctctaaagaggaacttctcgcggtagatgaaatcggtgaaaaaatggctgatgctgtgatcacctattttcataaagaagaaatgcttgaactcttgaatgaacttcaggagctgggcgtaaacacgctctataaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggtttcgggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaggaaggacaatatttagatgaggatacagtattaagctggctggcacggaaaaaaacgggctctgatttgaaaaaagccgaaaaagaagataaaaacttcaaaaatgaaggcttgaatccagcgctcccgagctctggttcaacagaagaaaagaacgaaagcagcccgatttatttagcatccatgcttgagcacgattatttagtcagaaaagacaagaattctatccagcttggcggcgtcatgatcggactggcgttaaactccgtgtattactatcgtgaaaaaacaggcgatccgcaaaaagaagtggagattagtgaaagcacgcttcgcaaacagggagaaaaaatcgcgcaggaggttattaaccgcctccgtaaaaaagataatttgaagaatgtgccgattaccgtcgcgctctacaagcaggcgtcaaaaacatcgattgtgccggggaacttcatcgccaaaacagaggtcaaagcaggctctactgatatctcaaattgggatgacatcaatgaaaaatatgtattctatccggcggatacaaccacagcagaaaaatacccggatgacaccgaggtctttaagcggtttaaaaattcaattgaagaatatttcccgaactatacaggcgttgtcggtacagcgctgtatgataatgatgaaatgaagaaaatgaagattgacataccaatgcaattctacggaaaaagtgaagttgtcgcgtttacccagttcttaacgggtgaagtgatggactactactctaagagctcagttgatgtcgaagtcaatatcacgtcctcagacggacaggaagcggtcattatccgcaatgctggagataaagagccgactgttcacatttatgactgatagaaaacccttgtgccatattgcacaagggtttttatgttacaattaacaggaaaagggaaattattttcgcttctgccgaaacgcaaatcaaggggaggtatgttgatgctggaaatcgtgtgaaaacaatcattatcaaacctatagcaatgaaaggatgttagacgtgcataaagatatcaaaaaaatatttcatgaagagcaggttttggcagaagctgcagcgaaatacggtttctcaaaagatcaggtgcgttttctggctgatgcggaaaactatgtatatgaatgtatgaaagccaatcaaccttatattttaaagattacccatacgattcgaagatcttctgattatataatgggagagatggaatggctccgtcaccttgcaatagggggaatttcagtagccaaaccgctcccgtcgctgaacggaaaagacgtagaagcagtgccggacggaaacggcgggtcatttttattgagagtgtatgagaaagcgccagggcaaaaagtggatgaatcggactggaatgaaacgctattttatgagcttggcagatacacaggcagcatgcacagcctgacaaaaagttacaaattgagcaatccctctttcaaaagacaggaatgggatgaagaggagcaattaaagctgagaaaatatgtgcctgaagatcagataaaggtgtttcagcaagccgattctttgatgaatgaactgcggaggctcccgaaaagccaggacagctacggcttggtgcatgcggatctgcaccatggcaattttaactgggatcatggcaaaatcacggcatttgattttgatgatatcggctacaactggtttgttaacgatattagcattcttctctacaatgtcctgtggtatccggttgtgccatatgatgataaagctgcgtttacagaagaatttatgacgcattttatgaaagggtactgggaggaaaatgagcttgaccctgcatggctgatgataatacctgatttcctccgtcttcgccatatgctgatttacggattgctgcatcagatgtttgaccttaacacaataggagaagaagaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacgtcggtcgtgtatctgtttttatggacgcggaccttcacttccataattggaaaatccttttcgcctaggtcgtcgatccgaacggagtgtgctttgatatctcttcttttcatttcttttaaaatctctgtcattttgtctttatcagaaagtgacattctgatgcggatgtctttttcctgcaggcggtcggggccgatttttctgaccacccatgggagaaattccacgctgatcaggatgaacagaagactggcaaacgcttctttataaaaaccggctcccgtagcaagcccgagccccgctgccccccagatcatggccgatgtcgtcaggccggaaatgacatcattgctttttcgcaggatgacaccggctccgataaacccgacgccggagatgatttgtgccggcagacgaagcggatccatcatgatgcggtagtatttagggaaatgatatgccgcattaatactgacgatcgtcagcatgcatgagctgactgcgatgacaatacaggtttttaatccgagcggcttattttttaattcgcgttcaagcccgatgaccatgccaatcaatgtggcaatgcccaatttcaataaaatatcaggatcaatataccagctcaacagcaaacttcccccttctctatggtgtttttaaataaatatgattttctcacagtatttatagcaaaacaagggcacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagatcaacacggtcgcagccccgacaatcatggcagcaagcgcgccccattcgttcattcgcttccaatacagactgagcagaatcgcaggcccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgttacagcacttgctgtgaccaagagctgtgaggaaatcgaactcatgatggcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcatgccgattcggcgtgcaggcttcaaatctttaatgtttttaatcgccataaatcggacgatgatatgaggctggccgtagtagcccaagccccaggctaaataggaaataatgctaatgacgctcgcgcctttaaaaatatccaataagtgtgggttaacagcgccgatttcatggagagtcggagcaacgccgcccacatgggtaaaagcaacgatcggcacaagcactagtgctgcaaacatgatcgcaccctgcacgaagtcagtcagactgacagcaaggaaaccgccaaacagtgtgtataatacgacaactgcggtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatccgccgcttctgtataagcacgcagccttggagccagcagcaagtaatttgagtacgccccgattgtaagacctaaagcaagccataaggtggacagccctgtcgcaaacatcgcgccgggaacacccatcagcatccatccactcatatcggccgcgccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaaacaaaagaaattcttttgcgggtgcacttggtaacttaacctaacaaagtattcccggccattcaagcgatgaaacattgatcataagctggaaataccgttgcaaacatagaagggaataaagaataaaacgctttcaaaaaataattaaagtaaaaatattcagaaaaatatttcgtttctccttcgcctcattttagtataaaatatatagggtattgtttcgaaaacacaggcctgtcttaaggcgttttgttgctttaaagggcttgtttttgatatgatcagtattatatgacttaacggagaaatatgtggaggtggatcatatgtcacgaatttcaatagaagaagtaaagcacgttgcgcaccttgcaagacttgcgattactgaagaagaagcaaaaatgttcactgaacagctcgacagtatcatttcatttgccgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgatgaatcttataaacgcatccaagcggttgatgataaggtacaagcctttttggcattagatgaagaaagagcgcgcgcatacgcgaaggagcttgatgaggcggttgacggccgttctgagcacggtcttcttttcggtatgccgatcggcgtaaaagataatatcgtaacaaaagggctgcgcacaacatgctccagcaaaattctcgaaaactttgatccgatttatgacgctactgtcgttcagcgccttcaagacgctgaagcggtcacaatcggtaaactgaacatggacgaattcgccatggggtcatctactgaaaactctgcttacaagctgacgaaaaacccttggaacctggatacagttcccggcggatcgagcggcggatctgcggctgcggttgctgcgggagaagttccgttttctcttggatctgacacaggcggctccatccgtcagccggcatctttctgtggcgttgtcggtttaaaacctacatacggacgtgtatctcgttacggactggtcgcatttgcgtcctcattagaccaaatcggaccgattacacgtacggttgaggataacgcgtttttacttcaagcgatttccggcgtagacaaaatggactccacgagtgcaaatgtggacgtgcctgattttctttcttcattaactggagacatcaaaggactgaaaatcgccgttccgaaagaataccttggtgaaggtgtcggcaaagaagcgagagaatctgtcttggcagcgctgaaagtccttgaaggtctcggcgctacatgggaagaagtgtctcttccgcacagtaaatacgctcttgcgacatattacctgctgtcatcttctgaagcgtcagcgaaccttgcacgctttgacggcatccgctacggctaccgcacagacaatgcggataacctgatcgacctttacaagcaaacgcgcgctgaaggttttggaaatgaagtcaaacgccgcatcatgcttggaacgtttgctttaagctcaggctactacgatgcgtactacaaaaaagcgcaaaaagtgcgtacgttgattaagaaggatttcgaagacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggtcttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgttattgacctcggatatccgggcgtcctgcctgttctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggaaaaacaaaacgcatcggcatcacgcgccttcaccttgaagaggatgccggaaaactgacacacacaggcgacggctattctcttgttgacttcaaccgccagggaacgccgcttgttgagatcgtatcagagccggatatccgcacgccggaagaagcgtacgcgtatcttgaaaagctgaaatccatcatccaatatacaggcgtttctgactgtaaaatggaagaaggctcacttcgctgtgacgccaatatctctcttcgtccgatcggccaagaggaattcggcacaaaaacggaattgaaaaacttgaactcctttgcgtttgttcaaaaaggccttgagcatgaagaaaaacgccaggagcaggttcttctttccggcggcgtcatccagcaggaaactcgccgttatgatgaagcaacgaagaaaaccattcttatgcgtgtcaaagagggatctgacgactaccgttacttcccagagccggatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagctaaacaagcgtctaactggctgatgggtgaagtgtcagcttacctaaacgcagaacaaaaagagcttgccgatgttgccctgactcctgaaggccttgccggcatgatcaaattgattgaaaaaggaaccatttcttctaagatcgcgaagaaagtgtttaaagagttgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaaagcagcccttagaggctgctttttttatggtcaaattgagataaagacagagatgagggcccgaagcctttcaacttctttgtcgttggttccggtcaaattggacagcatgcctttaataatcggcttgcgcggtttatcctgagtcaattcttcctcgataacatcaagtgacacggtgatatcctcgggcagcgtgctgttttctttcactttctgaatgtcctcaagcagctggtctttctccgcaggcatcgggttgaaaatgtcttttgacacaatcggattgagtgcagaacggctcagtccctgtacaagatcatccagtctctcaataataaaggctgagatttcttctgcatcgatattaagctcaccgttaaataccatcacgttcatataggaatgcacaatgcctctagccatgatggacagatctgcgacataccgctcgattccttcgccataggataccagcaaggcgttccggtacagcttatccgtctctgtggtaattttgtaaaaatattgcttgatttcttggttttccggaatgatattttcggtaagcaaaagaacgataaaatctttatgatcacgaaaatcctcaaattgtgcgccaatttgttttttcaaaacttctttaggcggctttccggcgagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttataattctctcttttttttcattcatgacgtgcttccccttaatccttgaaaaatttagtaaaattttctggtatatgagttgacgttgttgcgttataacgtttagtattatatagaatgaccagtcagtcaataaaaaatgtaatggaggatatgatgaatcacgttattaatttcgttctgaaaaacaaattcgccgtatggctgatgacgattattgtaacggcagccggcttgtatgcgggtatgaatatgaagcaagagtctattcctgacgtgaacatgccttacttgacgatcagcacgacatatccgggtgcgacaccaagccaagtggctgatgaagtgaccaaaccggttgaacaagccgtgcagaacttggacggtgtcagtgttgtgacttcgacgtcctatgaaaacgcatcgtcggtcatgattgaatatgattatgagaaagatatggacaaagcgaaaacagaagcagctgaagcgttagaaaacgtcaacctgcctgatgacgcgaaggatccggagatttcacgctacagcttgaattcattcccgattctgacgctgagcgtgtccagtgataaagataatctgcaagagctgacgaaacaagtggaggacagcctcgtttctaagcttgaaggcatagaaggtgttgcgtccgtccaagtatcaggccagcaggtggaagaggttgaattctctttcaaagaagacaaactgaaggaatacggccttgatgaagatacagtcaagcaagtgattcaaggttcagatgtgacaactccgcttggattgtacacattcggaaatgaagaaaaatctgtcgtcgtcagcggcgatattgaaacaattaaagatttgaagaatatgagaatcccgacggcatcagcttcaagtgcaggcagcagtgcagcatctcaagcggcggcgcagagtgctcaagcagctcagagcgcgcaagcggcagcacaggcgcagcaaagcgcaagcacagcagtgccgacggtcaaactttctgacattgctacaattaaagatgtgaaaaaagctgaatccgtttcacgcacaaatggcaaagacagcatcggcatcaacatcgtcaaagcaaacgatgcgaatacggtagaggttgccgacgatgtcaaagctgagctgaagaagttcaaagaagaccataaaggcttcaattacagcgcaactctcgacatggcggagccgatcacacagtcagttgacacgatgttaagcaaagccattttcggtgctatttttgcgattgtgattattctcttattcttaagggatatcaaatcaacattaatttcggtaatttcaattccattatcattgctgatcgcactccttgtgctgcagcagcttgatatcacattgaatattatgacgctcggcgcaatgaccgttgccatcggacgtgtagtcgatgactccatcgttgtgatcgagaacatttatcgccgaatgagactcaaagacgagccgctccgcggaaaagccttggttcgtgaagcgacgaaggaaatgtttaaaccgatcatgtcatcaacgattgtgacaattgcggtattcctgccgctcgcacttgtaggcggacaaatcggtgagttgtttattccgtttgccttaacgattgtttttgcgcttgccgcatccctggtgatttcaatcacgcttgtgccgatgctcgcacacagcctgttcaaaaaatcattaaccggtgcgccgattaaagcgaaagaacacaaacctggcagacttgcaaacatctataaaaaagtattgaactgggcgctgagccacaaatggatcacgtctatcatcgctgttctgatgctccttggaagcttgttcctcgtaccgttaatcggtgccagctacctgccgtccgaggaagaaaaaacaatgcagctcacatacagcccagaaccgggtgaaacgaaaaaagaagccgaaaatgaagctgaaaaagcagaaaaaatcctgcttgaccgcaagcatgtcgatacggttcagtattcattaggctctggcagcccgcttgccggaggagattctaacggtgcgttattctatatcaaatatgaaagcgacacacctgactttgataaagaaaaagataacgttctgaaggaaatccaaaagcaatctgaccgcggagaatggaagtcacaggacttcagctcttcaggcaataacaacgaattaacatactatgtgtatggcgattctgaaaacgatattaaagacacggtcaaagacattgaaaaaatcatgaaagatgaaaaggatctgaaaaacgtaaattcaggcctttccagcacatatgatgagtacacatttgtcgctgaccaagaaaaactaagcaagctcggtttaaccgcgtctcaaatttctcaggccttaatgtcacaaacatcgcaagaaccgctcaccacagtgaaaaaagacggcaaagagcttgatgtgaacattaagacagaaaaagacgagtataagagtgtgaaagatttagagaataaaaagatcacttcagcgactggccaggaagtcaaaatcggcgatgtggcaaaagtgaaggaaggatcaacatcagataccgtgtcaaaacgtgacggaaaagtctatgcggatgtcacaggtgaggttacatctgacaacgtcacagccgtatcagctgctatccagaagaaaatcgataagcttgaccatcctgataacgtatcgattgacacaggcggcgtatcagcggatatcgctgattctttcacgaagctcggtttagctatgctggcagcaatagcgatcgtttaccttgtgctcgtgattaccttcggcggagcactagcgccatttgcgattctgttctcattgccgttcacagtcatcggtgccctggtcggactttacgtatcaggtgaaacgatcagtctgaacgcaatgatcggtatgctcatgctgatcggtatcgttgtcacgaatgccattgtcttaattgaccgcgtgattcataaggaagcggaagggctgtctacgagagaagcgctcctggaagccggctctacacgactccgtccgatcctgatgacagccattgcgacaatcggcgccttgattccattagccctcggcttcgaaggcggaagccaggtcatttcaaaaggactcggcgtaacggttatcggcggtttaatcagttcaacacttctgacactcttgatcgtgccaatcgtatatgaagtattggcgaagttccgcaagaaaaaacctggaacggaagaagagtaaaaaaacaaaaagcctcagctctgctgaggcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcaggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctgatcattgcggcaggcggagacggaacgatcaacgaggtcgtcaacgggcttgcgcctttagacaaccgtccgacactcggtgtcattccagtcggcacaacaaacgacttcgccagagcgctcggcattccgcgagaggatattttaaaagcggcagatacggtcattaacggcgttgcccgcccgattgatatcggacaggtcaacggccagtattttatcaatatcgccggaggaggccgtctgacggagctgacgtacgacgtgccaagcaaactcaaaacaatgctaggccagcttgcttattatttaaaaggaatggaaatgctgccttcacttcgtccgacagaagtcgagattgaatatgatggcaagctgtttcaaggtgaaatcatgctgtttttggtcacgctgacaaactccgtcggcgggttcgaaaaactcgcgccggattccagcctgaatgacggcatgtttgatttgatgatactaaagaaagcaaaccttgctgaatttatcagggtcgctacgatggcgcttcgcggcgaacacatcaacgaccagcacattatttatacaaaagcgaaccgcgtgaaagtcaatgtatcagaaaagatgcagctgaacctggacggcgagtacggcggcatgctgccgggcgaattcgtgaatctgtatcgacacattcacgtcgtcatgccgaaggagaaagcggaacagctggatgactaaaacttggctttgtaagccaagctcagaatgttgacaaaatcctaaaacagttttcgttttaggattttgtcatcttttcagcgtgattgaaaacctttgaagtctaggaaggacgagcattggagcggagcgaatgttgaattcgtgagcaccgaagcacaggactgacaacgaatgcgaaggtttgcctacacgctgaaacttggcttgaacaggccaagtttttctttcgcttaaaactagaggtgattatagatgaaaatgaaacccccagtagaaaaaaacgaatactatgacgtgacttttgaggatttgacccacgaaggagcgggtgtcgcaaaggtccaaggctttccgatcttcgtgccgaacgccctgccggaggaaaaagcccaaatcaaagtgacacgcgtcaaaaaagggttcgccttcggccgcctgattgagctgaaggaagaaagcccgcatagaacggacgccccatgcccgatttacaagcaatgcggaggctgccagcttcagcacatgacctacgaaggccagctcctgtttaaacagaaacaagtcaaagacgtcttagaacgcatcggcaagctggacctttcaaacgtcaccgtgcatccgacactcggcatggaagacccgtggaactacagaaacaaagcacaggtgccggtaggagaacgggaaggcggactcgtcgcgggattctatcagcaaagaagccatgacatcatcgacatgagcgcctgcctgatccagcaatccaaaaacgacgaagccgtccaagccgtcaaagacatttgcgcaaactacggtgtcaaagcctacaacgaagaacgccacaaaggctggctccgccacatcatggtcagatacggcgttgttacgggcgaaatgatgatcgttttcatcacaagaacaaacgatttcccgcataaagcgaagatcatcgaagacatcacagcgcaattcccgcacgtcaaatccatcgtgcaaaacatcaacccaaacaaaacaaacgtcatttttggcaacgaaacaaatgtcatctggggcgaagaatacatctacgacctcatcggagacgtaaaattcgccatctccgccagatcgttctaccaagtcaacccagagcagacaaaggtgctctacgacaaagcgcttgagtacgctgagcttcaaggggaagaaaccgtcattgacgcttactgcggcatcggaacgatttctctcttcctggcaaagcaggcgaaaaaagtgtacggcgtagaaattgtaccggaggcaattgaggatgccaaacgcaacgctgaattaaacggcatcacaaacgcagagttcgcggtcggggaagcggaaaccgtgattccaaagtggtatgaagaaggcatcacggccgatacgctagtcgtcgacccgccaagaaaaggctgcgacgaagccctcctgcggacgattgtggagatgaaaccgaagcgggtggtgtatgtgtcctgtaatcctggcacgcttgcgagggatttgcgggtgcttgaggatggcgggtatcagacgctcgaagtgcagcctgtggatatgtttccacatacgaatcatgtggagtgctgtgtgttgctcgtgaaaaaatagaagatatataagggtccgagaatcggtaatgggttctcggactcccatcttctattatttcaattctttctatgactgacaaattagatcttggattttgaattgagggtaatattcctcatagaatttcttgaattcattatacagctctgtgttcattttgaatctgggcttcatacttagcttccttattgtaaatcctctcatcaagcatcaacattctattgaattggtacatttagagaaaaccttttaaagcatcaaagtgttcgggtaatactggcttgtccgactggtgataaaaataatcatccactttcatttctttcgtgaaatttgctgtatagaatacctaccatacctgctactttcttcaaatcacttttatatagaaggttcacttctacactttttgatggtttcgttgtaaagaatgtgtctttatccacaagcacaaccctctttctatttgtgaggatatagtagaagttagagcctatgattccatgagggattcggttttgattcaatatattggaaatgtatattttgaataggtagaatatagatggtaagtaatattcggcaagtaattgtcccttttaaaacacacctatttgtaactgcgtcatatgtagtttaacgttagtaaagtgaatttcattcgaagtctaattaaggagaaggtaataaatgatgaacccactagactcatcactttttctaaatagttatagtgttccatacaatggatttgaaaataacaatttggttttatcgatgttatattccaaagatactgtcattttgcattatttggttcttaaacaaaaaaacaaagaaaaatttatgatatgcggttttgatttcattagcgggtcaattattcctgtagagattacgaatataggtagcgttcttagaaatcttagggatttcttaaatagtgaatataacactatgaatatagttattgagtctattgacgaaattgtagaacattttgagaatgggaaaataaaaaaagaaattgatacatataagtctttatcaattctgacatcaacacagagaaatataataagtgggagctgtgaggtatacagtaacggtaaattaattagacctcataaaactttacttatatcgagtagaagaggtttagtttacgggaaatttgaatttgaaagtaatcaaaatgttattcagggtttgaaaaatatacacctttctgaggattgggttatcaggtattggataaatgataattctatagaatctgcagggacaatatatgaagtgaaaaaaggtatagatggaatcacaatttttctaagctcatttattcatgaattaagtaagaagaagatggatttcttttcttttcaaggttcagacccaaattcaccattacaggcgatattgaggagttccggaatgttaaaggaacaaattaatatagagggttttggagtaaaatttgttccttaccttgtgttgcttccaatagaaaatctaatgctaaataattttgaatttgggttggggggtgtaacctttttaactaaagaccaagcctttgatatgtataagggatttgaggagaaatataatcataatttacttggtcagtttgatacttttgctcaaacaattgtcgaatcagataacgtatatgatgcctatttattaggtagacaaaaagttcaagatgcaatcgatatgataattttactatccaaaaatgaaagagtgtttaatttatacaacttaggtaatgagctaaatgaatggaatagattaagattatatcaaaatcctaaatgctcttcactctattatgtggaaaatctagtaggcgtagaaaacattttgggtgattctaaaaacacctgggaaaataattctttaggtgtcgattctcaatttgaaaaagtttttagagaattggattggtatgaagaaaaactgtacaaaaaacagaccgggcagcaatcaactttagacaagcagttgtttaatgctttaaagtggttgaatagaagttggaaagcagaagatatagaagacaaggttatttatacaaacatagctatggaatttttggttgataaaattgaaaccgacccttttttgcctgatgaaattattagggaattcaaaaaattgttgaagcaactattaaaagaacaaagtgatacttttacagaagaatattctaggaaaataaaagaaaagagtttaggaaaacttaaagatcctcctttgaaaatcaaagttcaaaccttgattcggcatctatctattccaataactgatgaagactttagtaagttatggaaggttagagactatcgtaatgacctggtgcatggaagggatgaattaaaaataaacccagaaaacgttttgagtgcaaatatacttttaggagagttaattgtttatagattaagaagtatggaagaaggtgattgatataaacactttattagccgcctatcattttggaaataaaatatcaaaatccccttttggaaggacacttttcctaagatttaatgacataaagatcaaattatcaccggaagcatggtcactctatcacgatgcgattaagacatgtttatttcaacactattatagttttggacttgcctataaaaaaattgaggctatatgttcaaaaaaagagggatatcttcaaaaaagttttactgaattacaagattgtagcgaggtgcatttattaattgaggagggagatcaactcggcagagatttggaaaattcactttttcaaatgtttgcaaggctaccttcaaagaatatttctggaacctttaattcttttgatttatatagagcttggatgaatgttttttaccaattgcaaagcaccaaattattaacttacctacatcaacataaatcaaatatagaaaataaacaaggtaatgttcaaaaatttatggagtcaaaagaggtttatcctttctcaagacagaacagaatacttattcgaaaattagatataaagggtacacataaggagatcatgtattctttggaattttttgatgggcttagaaattccattctccaagttatttttgaaacccattttaatcgctcttttacactaaataaaaatgagatagttgaatacaaagaaaagaaacgaaataaagttcgtgttttttcgacaaaggtatttggcacggatgtttttaaatataaaggaaattttgtattgctatatgaaaacaataaactacaagaagtcggtttgataaagagaagagtaggaagaaacctggaaatgggtgataaatctatttcaacaattgagggcctattatatccaaaaaacgattacaatctttttgtaccagagctcacaaattaatttaagaacctttctggaacagtaagaaagtatggggtgttaatactacatcatcccttaactttttcttgattgataaaatcctcttcacgctttaatcgtttttactatataaattgttatggaaatatagatgaattcccactgctcaatattgttttgaatctactattcagcactctgcgcatcaggagtgtgtggcggttctgggaattagaaaaggcaactaacctctttgttagtgttgccttttttaaattggaaaaggcttatgtttccatgttttgaataactaatttcgggtatattcctttcaagtgagttcatccttctgtggatttcgatcagaagtctatcaacatcttgaacacggttaggatcaatatatttactcttctttagaagcttgtccatgtcggttaataacagagacaaatcatttagattgtcttgttgttcttcgaattcaacagaaagtacatttgtttgaccgtagctatttattttttcttagaggtttacaatttctcttaattggttttacattacttccacctatcttgtttttttatgcttttgtttggtctgcatatgaaagtttgaacataaacattctatcaccttgtcacctatctcttcagaaaaagagacacagcctaagctgcgtcttgtccttaatcaagcgttccgttttctgcaatcgtcatttccttgtcaaagatggctttgtctgctagggagttcgttgaatcgtttgcagctttgcttgtcatgtttctggatgctacgtttacttcatttcccaaggaagaactgataaagcttacaccgatcaaagcaattacagcgcacaaagtcagtttaaatttcatacaaacaatcccctctctgaatttgtttgcgggcatgaaccatctttttgaaacagataacagaatcatccatctgcccaatttcagtataaaactttgcggctaataatgccaactcttccatataaggatatccttgggatgtctctaatttgttgaaaacatttaataaaatggacgcttctccttttttgataaacagcgcctgcaatccttcaaacataattttaaatagattatcgtcgaatttacatgcgaagcgtacgccttttctgaaacaatccattgcctggtcttgtttatgttgaagaaaataaattaaggctaaatcgtggtaagcttgtgtcaagttgttgaaatttgattttttgaattggagaatcgatttctccatgtattttgctgctttcgtcaattcgcccattttaagataacaatttccgatattgaataaagcttggccgtaaatccgcttgtttttgctttcaagaagccgtgcgccttttagtgcctgttcaaggtgagggagcgccttttcatgactttctaaatcgtcgtagtttcctgcgatcacaaaatggcattgtatgcggcggactgagtaaaggtcgtgtgttttatagatgttatacgcctgagaagaatagtgcatggatacgtgggtttgtttcatatgataaaacacttcagccattttaaaataaaattccgcccgctcaatttcatctgaaatatagggaatggtgttttccgctttttgatagaatgtaatggcacttaagaaattgccctctttgaattcatacatcccttgaaaaaagtaatagtagtattcaacgagtttctccatcttcctgttgctgccttcaattctctttaaatattctgataactccatttggtttccttcagatggaatcacatagtcaatcataagctgatggcgaaatgcaatgagctgatagtaaatcaagaggtcttggtcttcttccatgatgtcaatgtcccgttcgatctcagctttaagcatttcagcatctgtcacattaaacttttgaatatgccggttccactcattaattttcatcccaacgtgcggagacgaaatcgtgcccaaacttctcacccttcctcttctcactaattatgtaaattttatcaatacagaaatttaataggaaggggttgagagaccgcaaaaaaagttttcggtgctgtccgcaaaagggagtttgggtgttttggtgttatatttggttttgtgtgggttagtgcaatctcaatttttgaattttagattgcggtgattatgacttaccagtttcatcatactttttaagagcttttcagttttatgtatttctctgagcatgggattcatgtagtcgctagctgattctaggtatgctcttgtcaaagtgtctagtttatttctaactttagagaggtcttcttcgaattgttcctctgttgaatgtttgataaattcttttgcctcttcatatctttttaatatgtttttcaccattggagttggattcttttgatttattgtttttattacagtgattgttaaattatttgttttattaattcttttcttactgtcaaggtgatgctccttttataaagtgagatgagataaaaataaagccctcaagtaagagggcttcatatttatttagaattttttacttaaacatagggtactgcaccaataaatttaaatgaatagtttttatcgtttatttctttctccctgccgtcatattcaaaattatataaaagaacagcagcattgatgtgttcaggaattgcggtacctactatgttctcaaatcgaggtaagatgacactatcgtacgaacagccgccaattagttcagataaattattgcaatttttttcatgtgcaactttttctataaaatcttcatctaattcatcgatatctatatcaaaatcaattaaaaattgggaagggagaaaatcaccttcatcctcattgtaatctaattcaacatatttacttaatgattcatcatcatttatacttccaatccacaatgatacgaaattttgacgttccatattaacctcccattatttagtccttaatccttctggcagtgctgccgctccaccttttagcctatagttcgcccaattatttaatcttcggacaaacatattatagtttaaggatgaatcaataattcctagcaattcattatgagcagcggttgaacccaatcctccgtgtttaccaactggattcacaaactcgactttgtttatggcagttcttaaatctctaatttgttcagctgtaactccccaatgtttgaaagtaggggccctagaaactaaatgccattcgtgcatgccgccgggtgctctcaattgtctttcaattgctcttctaactttcttatctgtccaaagctcatcaagttgcttcgttgttaatgagttgaaccaattattaaattcaccactttttactgtaggaattattgtttttctaggtttctttatgttctgtgtttttctttcagttttttgcaatgcatttgatttctgttcttcaatttcttttttcagaagcgatgtattctttacattatgcgtattctcaatatcctgagcaatccctgcaaaagcgacttgatttttaccttttaaagcactgctgaaatcttttgttttctggattcctgtctttacatgtttagtagtagctttttctccagcttcaagcactttatcgactttggcagcacctgctttaccaagtttacttgttactttcacaacagagccagcaccttttagtccgacgaggctcccgaccacataggtaatataatgagatcgtgagtatgcatcaccgttaaccattttatcattccatgaatctgctatgtttgtccatatgatttttgcataggaaggtgtcttcaatacagttgaaattgttttggctaatttttgttcttcggagagctgggaaaactcccacgctccgacagctaaatctttaacaccagtcacagtatccttagcgacatcgtagagaccgactccaactcctttcagaacttcccatgtggtttcaccaacttcttcgagctgttttgcttgctcaagctgcaccacatactgtaactgtgcaggctcaaggttctcatacccaatcttcttcgcaatttctaaatattcatcagggtcagataccccatccgcaagctttttcttcagtttttcaatctcgcgttccttcgcttcctcttttttaatcttcaagtaagcctcagtccgcttttcaatgtcgccttttttcttatgtatgtcgctctcacggtaagccttggcgttgtagtggatgggtgtggcgtttttgcctttgcccgttgcttcttggagcttttggaagtcggatttgatgaattgttcgtttggttcagacagggcgtattctgttttcaggtcttcgtccaaggcgtccaatttttccagtgtttttttgcgtttgtcgttggcatcggccagctcgtctttgaaggtttcggttgaaaacaggtcgagcgggaggatgtcgtcgatatcgtttaagatgtctttcatcgcttttttctgttcggacatgatagattttgattttttatttgcatttgccagttcgtgctccagaaaggattcttcgatgtatgcgtctgagaggcctttgtcctcggcggctccggcgatgctgttgaaaaatgcgattttcatatcgatgtagtcgatccactggtcggtgacgccgacgtggtcgtgatagaaggctttgatgttgctggcgccttttcctgaaaattcgctgtcactgagatcagcgacgctttttaacgcttttctcaaatttaccatttgcgttcttagttctttgtactcttttgcacggtctgtcgcttccgaaagcagtgttttcgcttcaaatactttcatgaccatttcccttcttttgttcactcaatatcaaaattttaccacggggcgggatgagggtgggggtgagaacgtgttttggtggaaaaatgagtcatttggcatgtgtctaagtgcatggttttgataagatgatgatagatcaataaaaaggggaagagctcatttgggtaaagatttcttaatcataaagatcaaggatattcaaaaaggcgacacgctaacgaaccgcgcttgcgggaactgggatatgaaattgtccagagcaaaggaatgtaaacgggcaattgttgttcggagcggtgtgattttaaatgtttacaagatcgttgacgcttgggaatctgaagaacccgccaagatcactaaaacgaataatagagtccggtttcaattggcagagtgccgtgactattcttatttaattggaagtacactgaaaacaaaaacgcaaaatccggtttcgagtctatccttagaaaccttaatggaactagtaaaataaaaggagcccagcatgtatctctataaagtaaacaaccaaaatcagctagaagatattcgcgagaaaccgtttaaaaaagaaaaagagattcaggatttatttgagaccaatcttcagcaaatgttggggctcagttttgtgaaatctgaattcaggattagcaatttccgcattgatacgttagcgtttgatgctgagacgaaatcttttgtgattatcgagtataaaaatacgaagaacttcagtgttgttgaccagggctacgcctatttagcggcaatgctcaatcataaagctgatttcattcttgagtacaatgagaatcatgatcgtccgttaaagcgggatgatgtggattggtcgcagtcgaaggtcatttttatttcacctgtttttacggtgtatcaaaagcaatccatccattttaaagacctgccaattgaattatgggagattaaaaggtacgaaaatgatctgatccagttgaatcaaatgaaggctgatggcgtctccgagtcgattaagaccatttcgcagcaaagtgagaccattcaagaggtcagcaaagaaattaaagtgttttctgaagaggatcatcttgcagataaaccgtttgacatcatagagctttatcagcagctaaaggaattcatttttaatttggacgatcatatttcaatcaaaccgacaaagctttatattgcgtttacatcaaataagcgaaatttcactgacattcttcttttaaaaagcggacttaagctgtgggtgaatatgaaaaagggagaattgcatgatcccgagaagagaatgcgcgatgtctctaagaccggccactggggaaatggcgactatgagattttcataaaagatgacgaaaacatagaatatatcatgggattgatcaaacaatcctatgagaaaaataagtgagaacttccatggagaagttcttttttttattggattacaagggatatgtacagggcatgttgaaaacgatatagagtttttaaccatttactgggagtttcttgtgtgaaaaagcgttttatactattgggcttgttcgcaagtgtttttatgttgactgtgtatatttccattcaaaataaaaatacgcatcctgtccaatcttccaccatccaccccgaagaagaccgcatcttttttatctactccaatcctttcataaaagaaagcacgctgctttcaacctctacaggcgaacggtttaacaggcgcacgtttaaggtggcggatgttccttatattcaaatgaagtcatacaaatccacagaccttgtattattggcggaacacgagcctttttactacacgctggagaaggatgtgatcaaagagcatccgctgtcagatccatttgcgttttggtatgaggggaaggatgtgtctgttaaggcctataatgttgatacgacgggaaatgagatccacataaacgacagaaaaacgaaaaaggaatatacccttaccttgccttcgcttgtcacgatgggggccagtgatgagaactatatttatatcattcaaagcatgtctatttacgtgattgacagaaaaacagaggaaatgattgagaccctgagcttagcctcatacgctgatcaattcgcagactcgaaggaatttattgttgcgagctcggagcatgaattgactgtgattgaaaaagggacatggaaaacgacatatattccgtatcctgatgatcttgaatacgctgataccgtatactatgacaaagaaagcggaagtttttacgttacgtacgaagacaaagagggtgaggcgaacttgctggagtatgggaaggaattttcttttcatacatatagtttgaatttcccttatatggaagcgaagtttaaggggaatctattgtatatagttgcccaggaagagcataaaaagggcatcggcggatacgtgggtgtgtttgatatccattctaaggagatgctttatcagtttgatttgcctgaggaacaggtgaaggttcaggattttgttgtggttgattaaagtgaaagctcttagcgtctttttcttttttgttcaagagttgatctttgctgataacagtgtcgaaattctatgaaactttcattcaaagtacgcgtatatgaaccaaaaggaggacgatgaagcaatgggtggttcatatttgagtgatttgtgttcaatgtatcaaaaagataagttctttaccggatttgtccctgaggagcttttgacatatgcgtgtgagttattcccgttatcgaagaaagaaacggtgacggccttactgaattgttccatgggaagtaaagcgaaaagctttgttatgtttacgagtaagggattgtactggaagagatttggagaacaagagggatgtgtgacttggggagcattcactgatatccaatcgattaaatcgatggatgattatgagatttggtttgatggagtagaggtttttgatgtcggcttcagttcatatcctgcggatctgttggcagagctgttgaggataattcagcaatttcttagtgaaaatgacttggatttgcttacggaaccccagatagatcatgtatctgtttctgccagtgaattgagggaaatcagtattttgtttcagaacagccatgacaagatgttcggtttgaccaatgggctactggtcggtaacgagatttctgaaaagagagaggtacgattgagaaaacggctgcatattcctaaggatcaggagatgatctccttctggagtacttttcccgtgaagcaaacagatggcatcacattaacagacaaagggatttatttttcagatccttttctcaggttattttatccttggcatgtgtttaaggaaacgcctgtaatgttaaaagatcaggagttaattgtggggaaaaagaatgtcattcaattgctggaaaacctgatgcctgctaaggacgtatttgcttttttagaacaagtaaaacgaagaatcagcgctgttacgagctggtgaatacgtatttgaaataagattgacatgggacccttgcataaagggttcttttttatgaaaaaaacaaattgacaggatgaaaaaacaatttcttccttctgtattgttttcaaaatttgggattgatagaatatgacatatctcatagagaaggagggaagccgttgagtcaagccataccgtcttcgcgtgtaggtgttaagattaatgaatggtataaaatgattcgccagttcagtgttccggatgctgagattctgaaagcggaggtggagcaggacattcagcaaatggaagaagaccaggatttgctgatctattattctctgatgtgttttcggcaccagctgatgcttgattatttggagccgggacaaacatacgggaatcgccctacagtgacagagcttcttgaaacgattgagacccctcagaaaaaactcacaggccttttgaaatactactctttgtttttccgcggcatgtatgaatttgaccaaaaagaatatgtggaagcgatcggatattatcgcgaggcggagaaagaactgccgtttgtgtcagatgatattgagaaagccgaattccattttaaagtggcagaagcgtattatcacatgaagcaaacccatgtgtcgatgcatcatattcttcaagccttggacatttatcaaaaccatcctctatacagcattagaacgatacaaagcttgtttgtgatcgccggcaactatgatgatttcaaacattatgataaagcgctcccgcatttagaggcggcgctggaattggcaatggacattcaaaatgacaggtttatcgccatttctctattgaacattgcaaacagctatgacagatcaggagacgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgatgaacgaaaaattcatgatcttttaagctatttcgaaaaaaagaacctgcacgcttacattgaagcatgtgcccggagtgctgccgctgtttttgaaagcagctgtcactttgaacaagccgctgcgttttatcggaaagtgctgaaagcccaagaagatattctaaaaggagagtgtttatatgcctattaagaaaaaagtgatgatgtgcctggctgttactctattattgggaagcatgtcgtttccaaccctgacaaactccggcggatttaaggaatcaacagatcgaaatacgacgtatatcgatcattccccttacaaactcagtgatcagaagaaagcccttagctagggctttttcttgctttacggaagacgttccattttccacatcgcggcattccttctatttctaacgcaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcaaatacgagtcggatttatgcgaagtttggccgtgagatttatgtggcggcgaaacagggcgagcctgatccggaatccaaccaggcactgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaacggctgacgaagcgcttgaaatcctgatggaagcggatgttgatgtacgtgacattttagaagaggatgacagcgcgatcgtgtatgccgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattgattgatgcattagaagatttggaagatgttcagcaggtatatcataacgttgatttaggtgagtaaggagtgagcaggctgttatggcctgctttttttgtcccggaaattgttttagctgtatgtaggcggccgcctatacgatctataagatattctcatactctggactgtaacctatgtgaaggagagagtgaatatgactgatacaagacatatgtatggcggacctggttttggtcattatcagggctttggtattggccacccgggctatggcatgcaaagcacaggctatccgggctatggcatgtatggaggccacccgggctatggcatgcaaggctacccagatcacggcatacatggaggagtcggcggctatccgggatatggtgggtacggcggttacccaagcggcggctatggaggctctccgggagctggaagctatccgaacatgcaccatgaaaatgatggccatcaccactattatcaccatcatcaccatgttggaaaggataatcatcaccaccatcatgatggtcattatggccaccatcaccaccatatgggccactggggaaaagacggttataaataaagaagatgatgataaaaagaggacactcttgcagatcaagagtgtttttttagcttttttcttgactattcagtctggaaactggtaacatttgtttcaggaggtgatagtcttttggggaggaataaagaatttgatacggcgcttgttcttcacagggcgatagaggtttttggagagtatggctacgaaggaacgtctcttcaggatctgctctctcatttaggcattgcgcgccaaagtttgtatgatacgtatggcacgaagcgtgatttgtttttgtccgctgtgaaaacgtatcttgaagggaaaaacactgccgttatggaaaggcttgaagcgccaggatctgtaaaggaagccattcgtaatatttttcaagagggtgtcaatgctttgagggatcctgaacgggcgaaggcgtgctatatcattaacagcgcgattgaacagattccgcatgaccctgagcttgcccggtattttgacagacaatccaagcagcttgaggaagctttttatcaggcgcttttaagggcgaaggatcaaggagaattgaatggcgaagatactgatatatctgcgcttgcccggtacctgaatcaaagcaggctgtctctgacatttgttgcgaaagtgacgtctgatatagatcggcttcaggaccatgttgacgtgagtttatcagtgcttgattaacatgtggtaaaggattctttgcccatgtatgtactttttggactgaatagtctagaaataaaaatgaggtgatgatgaatgttgatgaatgagtttgaaaaagcatgtgaaacattgagaaagtttatggcttatatgcttgagaaggacatgaagagctggacggagctttgggatgagaatgctgtatttgagtttccttatgcgccggagggatcaccaaaaagaatagaaggaaaagcggccatttacgattatattaaggattatcctaagcagatccatctttcttcatttaccgctccgacagtgtaccgttcagcagatacgaatacggtgattgcggagtttcaatgtgacggccatgtgattgagactggactgccttatcgccaaagctatatcagtgtcatcgaaacgagagacggccgtattgtgcgatatagggattattggaatccgcttgttgtaaaagaggcctttggaggatcatttttgcaaacagaggagagtgggaaatgatgaaacagaatccgattttaatcacgggcgggaccggcacagtcggcagccgaatcgccagccgtttaataaagctgggacacagggtgcgtattgcgagccggaaaaagggcgcgcttgctgatgctgagtatgtgtattttaattggaaggacgcctccagttttacgcctgctctggaacaggtaaaacagatctatcttgttgctccggtcggtgtatttgatccggctccctatgtgctcccctttttaaaggaggcaaagcgtctcggtgcaaagcgtgtagtgatgctaagtgcgtctgttgttcctgagaatggccccgtgtttggcgcgattcatcaggcagtgcgcgaatttcccgaatggacggtgctgcggccttcatactttatgcaaaatttcatcaatgtccagcatcgaatgtcgattcaaactgaggggcgcatcatcacggcttcgggtgagggaaagctaggattcattgatgctgatgacattgcagaaacagccgtgcgtgctttgactgatgccgtccctcatcagacacatcatatcctgacaggacctgaggcgctgagctatgccgaagcggcagagattatcggtacagcggcgggacgccgggtggagcatgtcatcatttctcgttccgagctgcagaatcggatggaagcagctggtttgccggctgattatgcgggatttatggcggggcttgatgaggcaatcagccatggtgcggaacatcgggtaacggatacagtgaagcgtgtgacgggaaaagaccctcgttcgctatcagagtttgcggctgctcatgctgtgtattggaaacactgatctcattttggactaagtagtctagaaagaccttcggcgcttccgaaggtcttcttattgaaaaagctaagtcgtgtttcagtcataatcatgcctcctgcctcatacctattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcatatggagcagttttcgccgatggaggctttgagaaaaggcaccctttggaaggatctctatgatttttatgaaaacccttatcgagggggagacgcacatggcaaaaaaggttgatgccgaatattatcgtcagctagagcaaatacaggctgctgattttgtgcttgttgagctgagtctttatttgaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgagcagtatggcggagcggacggcgagctggccgcagctctccggtatttgaaccagcgttatacgattcctgataaggtcatcggtcttttaacagatatcggcacggaggagtttgcccatttggaaatgattgcgaccatggtctataagttaacgaaagacgccacaccggagcaactgcgtgaagctgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgattccctgcgttttttgcgtgagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaaggtgtgtgtgcaagcttactttttgattgggaggcctttatgtcagcttttaagattgagaacgaaacgattgcagatggattttacgcgtgtccggccgtctatgaggatgcagaatcgattaccgggttgctcgtacgaacagctgaatggctccgggatcggggttctaaccaatggagcggacttctgaaagggcaagatatacatgatatcacggggtcaattgaaaagggacatgtgtttgtgtttaaaaaagatgaagagcttgcggctgtcgtgatgctgctgcctgaaccgagcgagtgggaccggacgctttggggagacgatgggcatgaggagtccatttatttgcatcgcctcgcagtaagccgccggtttgcgggacaggggcttggagcccgcgtccttcagtgggcggagacgggcatacactttccggaaaaaacgcggatccggcttgactgtgtcgctgatagtgacgccctgcattccttttatcggcgtatgggatatgaattcatgggtgctgatgcgtccggatatcatttgtttgagaaagagattacggcagaataagcgtcctttgcagggggcttttttgtcttttctaaaagggagggcaggcgatgttgtggccaatattatttgtgacagggatcgtgacggcttgtctgtttgctggcgtatccgttttgatgcggatgagatttcctgacaaaagtcggccggaatggatgtaggccgggctgatcgtccttggtgtgtttctgatctggtagagcctcgtatatgcacgcggctgggaaggggctgcgctcggaatgcttggattcaatgtcattttcggagccattgccggatatttgatcgataaggccatccggcgttactggaaaagataaggctgctgctgtctctcatcatgtcgaaattttcacagaccggcaggaattttctttcgaaaggagaaatacatattactttaaaatgaaagcgttttccaaagcaggaaggtgatgttgatgatacacagtgtgacaaatgggctgaatcgtttttgtacgtgggtgatgagactggcctatttgaatgtgctttggattttgttttctcttgcaggcctggttgtgtttgggctgatgcccgctactgccgcgatgtttacagtggcgagagaatgggcgaaggggaatacagatgccccggtgttttctgtcttttttcggacgtttaaaaaggaatggcgggcatcacagatcctcgggcttatcgttgtgacggctgccctgtttctgtttgcggatatgcggatagcggctcagatggaccagcctgtgctcgtcaatgtattcctgagcattagtttgattttcgcgtttgttgtgctgtatgtgttcccggtattttctcattttgacgtaaaaatcagagaggtgctgagcatcagctttttcattgctttcagccgtccggcggtaacgcttttgatggcggcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctgtttgtatacagcggggtccagtatgcctttcatgtgtatgatgagcagatttaccgcaagtcctcggaggtgcttcggatgtcttctgaaaggatcgaagacgagctgaagaagatagaggatgtgtcatatgaaatcattacagacgaacagattcagcgcatcatgagtatgcaaaatcgggatgatacgtatgatcaatatcaaatgaagcaggagctgtgggatcagcttgcgggatatgccagcgatgaaaagtacatcgattccattcatgtgattgatgcccgcggctcagagtattcagccggaagcagttcttcagatcttttgcagcaggagcaggaagaggtatttaagcgagcgaaagcgaaaaatggaagaaatctttggatgacgctcggcgggtcagatcctgtcctgatttcagcacggcagatcaggtcctatcaccagctgagtttgaacggcttgggcatggtgctgatccaggtcaatgtaaaacagatgattcgtgatgtgccgaaggattggggcgattcagtcggagacattatgattgctgaccaaggcggtaatttggtgtatacggcacatgcatcagcgcatgttcctgaggcagcaaaagagacgctgaagcaccccggttatgacttgataaaaaagaatggcaaacgttactttatttcttaccttcaatcatcctaccaaaattggagctactataacgttatcccctttgatcagatgttcgcaaaaatttcctttatgaaaacagtgatcggcacatgctttcttctctttttctgtgtggttttgcttttcggaaggaaaatcgccaacagcatcacggagccgattgaacagcttgtgaccgcgatgaaatcggtgcagcacggcggcattgaagcaggtgtgtcgctttctctgccggaacatacacaggatgaggccggcatgctgaaccgccattttactgtcatgatgaaacggattaatgagctgatggaagaaaatgtggaaaaacagctcattattaaagaaaccgaattgaaagcactgcaagcccagatcaatccgcattttttatataacacgctcgagtccatcaattggctggctaaggcgaatcagcaaaagcaaatctcaaaaatggtggaatcgctcggttttcttctgcgaaacagcatacatatgaaaaaggatatcgtgaccattcaggaggaggcggacattgtacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaaggccatgcgccatccggattcaggccaaaaaggcgaagggctgtgtctgtattacggtcgaagataacggccctggcatggatggacggattcttgaatcaacgggcggaagaggaatcggactttggaatattcgcgagcgcatcagcctgacattcggagagccatacggattgcggattcatagtgagcatgaaaaggggacgaggattgtgatcacaataccgtgccgaaatgaggtggtgtgatgtataaaatactgctggctgatgatgagaggattatccttgatggaatggcgggaatcattgagtgggagtcgcttggcgcctcattgatcggtaaagcgcagaacggacatgaagcatatgaaaagattgtacataagcagccgcatatcgtcatcacagatgtcaaaatgcccggcatggacgggcttgagctgatcaaaaaggtgtcagccgtcagcccgtcggtgcaatttatcgtcctgtccgggtttggagagtttgagtacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctaaaacacgagctcgaccatatccgttcctttgcagccgatcaatacttggaaggcttgatcgccggtgtggcccagctttctccgccgccttcacttgccggaaaaaagatccgcctcttgatcttaaaaggggaacaatctattgatgccgcagccagagaggcactcgggtcggcactgacagcggtttgcagcagcggagaatggaccgtgctcgccgtagaggagaacgccgctgaaaaggcggaggaggtttttgcggaccgcaagctggtcatcagtcaggcgggagaactccggcacgcggggcagctgtttcgggacacagctgaagcgtctggtgacctgcatgggagcgcagtgatttcgaaaatgatcaggcttattgccgacgagctcggaaatccgaatctgtccttaaaatgggcggcgaaggatatgttgtttatgaatcctgattatctcgggaagttatttaagcaggaaacaggcgagaaattttcccaatatgttacacgagtgcgtcttgaacatgcgatgaaacagatgaaaatgaggcgggatgcgagtgtatcagaaattgctgaagaaatcgggtttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaaggggggattggtttgaagaagatttgttacgtgctgttatcccttgtctgcgtcttttttttcagcggatgttcagcgggtgaagaggcctcgggaaaaaaagaagacgttacactcagaatcgcgtggtggggcgggcagccaaggcatgattatacaacaaaggtaattgaactttacgagaaaaagaatccgcacgtccatattgaagcggaatttgcgaactgggatgactactggaaaaagcttgcgcccatgtctgccgccggccagcttcctgatgtcattcaaatggataccgcttacttagcccaatacggaaagaagaaccagctggaagatttaacgccgtatacaaaggatggaacgattaacgtcagttcaatcgacgagaatatgctgtcgggcggaaaaatcgacaataagctatatggatttacgctaggtgtcaacgtgctgtctgtgattgccaatgaagatttgctgaaaaaagccggtgtgtctatcaatcaggaaaactggacgtgggaggattacgagaagctggcgtatgatcttcaggaaaaagccggtgtctacggttccaacggaatgcatccgcctgatattttcttcccttattatttgcgcacaaagggtgagcgcttttataaagaagacggcactggcctcgcgtatcaagatgatcagctgtttgtcgattactttgaacggcagctgaggctggtgaaagcgaaaacgtccccaacacctgatgaaagcgcacagattaaagggatggaagacgattttatcgtcaaaggcaagtcagcgattacatggaactactccaatcaatatttgggctttgcccggctgacagactcgccgctgtctctctatctgccgccggagcaaatgaaggaaaaggcgctgacattgaagccgagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaaaccaacatcgtggagtatgtagaaaccgcgtcaaaaaacatcagcaaagccgatccgccagagcctgtgggaagcgcggaggtcatcaagctgctgaaagatacgtcagatcagattctgtatcagaaggtatcgccggaaaaagccgccaaaacgttccggaaaaaggccaatgagatattagagaggaataattgacgggaaatggggctgacgcaatgaaaaaaagccggagtataagaaaagacaatctggcgggatatgcttttatttctccgtttatcatcgggttcctatgctttacggtgattccgatgggggtgtccctgtttctgtccttcacgagctatgacttgtttacggcgccgaaatggatcgggctcgacaactttaaggaaatgtttacgggtgacgaaaagtattggcagtctctgaaggtgacgtttacgtatgtgcttgccggggttccgctccgcctcggcttcgcgctttttatcgctgtcattttaaacaatgcagcaaaaggaacggccatttacagaacgctcttttatttgccttcgatcatcggcgggagcgtcgccgtggcgattatgtggcgcaatatttttggcaatgacggggtcatcaatgcgctgctgttttttgtcgggattgatcaaaaaattctttggtaccagaatccgacaagtgcgctgtggacattgattctgctgtccgtctggcagttcgggtcgtcaatgctgatttttctggccgggctgaaaaacattccgtcttcgtatttggaagcggcaagtgtggatggggcaaatcgggtgcagcgtttcttcaagatcacgcttccgatccttacaccgattattttctttaacctagtgatgcagacgatttctgcttttatgacatttacacctgcctatatcatttcgaagggcgagggcgggccgcttgacgggacacttctctattcgctctatttgttccagcgtgcgtttaactattttcaaatgggctacgcagcggcgatggcgtgggtcatgcttgtcattgtcgggctgattacgctcatattgtttaaaacatcgtcatattgggttcattacgagtcaaaggaggaatgacggatggagccggtcaacgagcctgtcagaaaagccccggtttttgaaagaaaaaaagccgggcgcgtcagtcccaaacgcatactgttccatgtttttacggcaacgctggcggtgttactgctgtacccggtcatttggctgtttgtcagctcgtttaaagaaagcgccagtatttttacaacctcacattctctcattcccgacccttttattctcagtaactatgctgaagggtggaagggtatcgcgggacagccgtttctgacgtttattaaaaactcggcgatcattgtcggactgtcaacaatcggtgccgtcctgtcatcggctgtcattgcgtacggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatctttctgatgatccagtttatccggacgattcccgaggagctggatgaagccgcgcgaatcgacggatgcgggcgctttgcctgcttttggcggatcattctcccgctgattgcccccgcgcttgcgacgtctgcgattttctccttctattggaagtgggaggagctgattcagccgcttttgtatttgaataagccggagctttaccctgtttcacttgcgctgaagctttttctcgatacagagtcggcttcgaactggggcgcgatgtttgccatgtcggccgtctcgttattgcctgtgattcttgtattctttttgtttcagaaatatatcgttcagggcatcagtacgaccggattaaaataaaaaggagtgttgcagatggcacagcttatctttgatgaagaaaaggtgacgtcggttattgaccggatcgtgaaacggacatttcagatggattttgcgtgggattggcctggcggcgtcgcgttttacggtgtggcggaggcctatgaagcgacggaaaacgaggaatatatcaatctgttaaaaacgtgggtggatgaacagctggaggatgggctgccgccgctttcgatcaacggagtttccatcgggcatacgcttttgttcctccacaaggtgacaggtgatgacgtgtatttggaaacagcggccgagatggcggaatatgtgctgcataaggcgccgcgctttggcgagggtatccttcagcatacggtgaatgcggcagaatacgtattccctgaacaggcatgggcggatacgctgatgatggctgggctgtttatgctgagaatcgggcgggtcatggagcgtgaggattattttgaagacggcctgcgccagtttcacggacatgaggatgtgcttcaggaccctgtcacgaatttgtactaccacgcctgggacaacaaagcgcaaaatcatctgtcggggatttattggggcagggcgaacggctgggcggcactcacgatggcaaaggcgctcccgcttattgaggtgacacatccttcctttatgatcatcgacggatcgctcagagaccagctgagcgcgcttgtccggcttcaggatgaatcagggctgtggcatacgattttggatgatccggattcttatctggaggtttcggcatcagcgggtattgcttctgctctgatgtcgagcggaaagctgtatacaaaatatgtgcagaaatcgcttgccgccattttggatgcagtggaagaggacggacgggtcagcaaggtatcggccgggacagccgtcatgaaaaatgccgaaggatacaaacaggtgccttacaaacgaatacaaggatgggggcagggacttgcgctgacgtttcttgctgatgttttgaaaacgaaaaaacgcgtgtatcagtaaagatagcggcggggggagagggatgaaaaaacagcctcaacagaaggaacgggtttctcgctggaagggaacgtatttcaaaagaaactttgtcttcattttgctgattgcctgtattcccggattgctgactggcggcgcaatctactttctttcgatcgacaaggtggagaaagagctgcaaaggtcgcatgaaacacaggtggcgcgtgaggtcagccgaatggatgagaagctgggagtgcttgaactggcactcacccagatggcctacgattcttcactgatgaatggattggccgagagggatttggagaaagactttacgttctcctatcaattaacgaaaaagctgtttcttttgcgggaccagcagccgctgatcgagcaggcttccatctttctgaacagcccccggcctcttgtgctgagccctgaatacagcgctttgacagaacaagagggccttcgcaagtatcgctcgctgcttgcctcagaccacagcatttattggaaacggtcgggaaatcaagcgatgctgatccagctcattccgggcgcggcggagaaaccgttcggcgcgatcatgctggcggttgatccgaaagaaatggaatcaatcctgcaaagcttgtccccctatcctgatggcagtgcgctgcttttagatcaaaatcaagaggtgctgtttcatgaaggggaaaaagattttgaaaagactttacttcaagagataaaaaaacagcctgctgagaaaggtcattttcagatggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtgtgcatgacatggtatgcatcaaaaaaaatctatcgtcccattcagcatttgcttggcttgtttaccggtggagagaagaaagtatggcaggcgtccgggcaggatgaattcaagtggattgaaaagagatggcaggatctatcccttgaaagccggaagctccaagagcagctcctgcggcagacgccccatatgaaaaaaagttttttgcagcatctcttgcagggcgatttttactatgacaacgaggaaagcctcagattgcggatggaggaggctggctggaacatcggcggaaacgtgtttcatgtgcttgatctacaggtgacagggctccgttgtgaaaaaagcatcttccgtgaaggtgatgaacagcttgccgtgtttaccctgaccaatctggctgaggaattggcggataaacacgtttttcagctctccatacttgatatcggccggctttctgtcaccgttcttgtgatgaaaacaaacagctctgatctgaaggcgtatataacggagctggcacgccaatttggggatgtaaccggactatgcctgacctcgacatggagcagcaaaacggagcgtgtcacggaaatcccttctttatttcagaatgtgaaatgcggcaaatcccgcaggaaatttgctaaccgggatcaggtcattgatttgcaggccgacttccctcaggatgagcagttcgctccttattacccttttgagctggaaaaacaaattgttcaggccatccggctggaaagaaaacaggaagccaaggaactgatagatggatgtatgagggaactggcggaaaaggcggccatagacaggcatgtgcattccgccctgattcagctgttttcccgcattcaggaggatattttgcattccgggctcaatcccagcgaactgtttcagcaccggaatccgtttcttgatatttcagaattgcgcgaacctaacgaagcggcggcctggctgatggatgtagtggtgacgccttacctttccaagcttgagggcagaaaaaacagacagcaaaagcagctggcagaacgtgtgattgcgatgattcacgaacagtatatggcggacatttcattggaaagctgtgccgatgcgcttggcatgaattcatatacgttaagcaaggcatttaagcaagtgaccggcattaattttatcgattatgtgacccagatcagaatcgaaaaggcgaaagaactgctggtcaatacgaataaaaaaattcatgacgtgtcagaagaagtcggctaccgccacaattatttcaatcggatttttaaaaaacaggtcggcatgccgccgggtgtcttcaggcaaatgtatcaggaaacgccgtgaaaggagagaacatgtgatgaagaaaccgattcaagtatttttagcgggagattccactgtgagtgactgcccgcctcatgaagcgccgatggcggggtgggggcaggtattcgggcaattgttttctgaagatgtgctggtccgcaatcatgccaaaggaggagcgagcaccaattcttttgtggaggaaggaaggcttcaagcaattgccgagcacatcacacaaggcgattatttgttgattcaattcggccacaatgaccaaaaaccgcgggggacgaagccgtactccacatttcagcagtttcttaccttgtttgcagatacggcacgcgaaaagggcgcgcatcctgtgttcgtcacatcggtgcagcgccgccgctttgatgaaaacggacggatcgagcatacgctcggtgagtatccagatgcgatgaaagcactggcgaaggagctcgatgtacctgtgattgatctgcttgcgaaaacaaaggtgctgtatgaagcatacgggccggaggagtcgaagcgattgttcgtttggtttcagccgaatgaacatccgaattacccggacggcattgaggacaatacgcatttttcggaaaaaggtgcaatggaggttgcgaagcttgtggcagaaggcattgaagagatcggacttccgcttaaggaccgccttgtgagccgggaggggaaagaacatgtataaggaaggcgcgtgcctgtaccgtaatccgctccggtctaaaagcgatgtgaaggactggcggatggagggaggcggacagatctcatttgacgatcacagcttgcacctgtcacatgtccaggacgaagcgaactttgtcttttggtgtccggaaacctttccagacggcatcattgtgacatgggacttctctccgatcgagcagcctggactgtgtatgctgttttttgccgctgcgggtattcgcggcgaggatttgtttgacacaagtctcaggaaaagaacaggaacataccctgagtatcattcaggagatatcaatgccctccacctgtcgtatttccgcagaaaatacccggaggaaagagcattccgcacctgcaatttaagaaaaagccgcggtttccacctcgccgcaatgggggccgatccgctgccttctccagacgacgctgattctccgtatcgtatgaagctgatcaaagacaaaggctatgtgcacttttcaatcaatggtctgcccattcttgagtggatggacgacggcagcacttatgggcctttgttaacaaaaggaaaaatcgggttccggcagatggcccccatgaaagccgtttacagggattttgccgtgcatcaagcggtgagaagatgaagacgactgtaacggatgcgctttatgcaggctgcgaagcggtggtgaaaatagcatggctcaacgggctgtggctgttgtttacacttttgggcggcgttcttttcggatgggcgccgagcacagctgcgatgtgtgccgttataaggaaatggctgatggggcaaaaggatgtcccgatattttcgttatttctcgatacctataaaaaagagtttctcaaggttaatgcgatcggattggcgttttcggctcttttgctcatattgtctgccaactatcattatttttctgccagtacgaattggctgtcctttgccgtaacaagctgcacgctgcttgcagggcttttgtatatcatcgcgctgatgtatgtgtttcccctttatgtgcattaccagctcccgcttcgcaaatatattccgcaggcactgctgtttggcgccatgaggccgctgacgaccggctgtatgctgatcgggtgcggatttgtcctttatttgctgtatacgcttcctggcctgattccgttttacggcccatgtttatttgggcttgtgttgatgttttttgctcttaggggatttcaaaagacggaggcccagcaccatcaagccgggtaacaaaaaaatgacaaatacgcaaaaaagtgcagtgtccgaaataggcagatgcaaaaaagtgaaattgaagacagctcacatagcgcataaaatccaatttaagtaagcgcttacagataaatgagaaggagctgtctgatgattagacgaaggaaacgcatgtttaccgctattacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaaccgaaaacgcatctgttttgttcaatgtgtacagagacgggcaaaaactgaatgctgcgcctgtcaaaacaacgaactatgtggataaaaacggatcggcgggctcaacgtatacggttcgggctgttgtaaacggtaccgaacagccggcttctgaaaaagcctccgtatgggcgcagccgtatcattccgtcccgctggataaaccggctggcggcacgacaccaaagggtgaagcttacacgtacagcgctaatgacgcaagtgttggcgatgtggatggtgacgggcaatacgagctgatcctgaaatgggacccgtctaactcaaaagacaattcacaggatggctatacgggtgacgtgctgattgacgcgtataaactggatggcacaaagttatggcggatcaatctcggcaaaaacatcagagcgggcgcgcactacacccagtttatggtgtatgaccttgatggtgacggaaaagcggaagtggcaatgaaaacggcagacgggacaaaagacggcacgggaaaagtaattggaaatgccaatgctgattacagaaatgaacaggggcgtgtgctttcaggccctgaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgccggacaggggaatcacaacctgagcatcgcggacgttgacggggatggaaaagatgagattattttcggctcaatggctgttgatcatgacgggaaaggcatgtactcgaccggcttaggccatggggatgccctccatacaggagatcttgatccgggccggccggggcttgaggtgtttcaagttcatgaggacaaaaatgcaaaatacggcttatctttccgggatgctgcaaccggaaaaatcctttggggcgtttatgccggcaaggatgtaggccggggaatggctgctgatattgacccgcgttatccgggacaggaagtgtgggcaaacggttctctctactcagcgaaaggggtcaaaatcggaagcggggttccgtcctctaccaacttcggcatctggtgggacggcgatctgctccgggaacagctggacagcaaccgaattgataagtgggattatcaaaacggcgtatcgaaaaatgtgctgactgcatcaggcgcagcggctaacaacggcacaaaagcaacaccaacgcttcaggctgatctgctcggtgactggcgcgaggaagtcgtgtggagaacggaggacagcagtgcactgcgcatttacacgacgaccattccgactgagcacaggctgtatacgctgatgcacgatccggtgtaccggcttggcatcgcctggcaaaatatcgcctataaccagccgccgcacacaagcttctttttaggagacggcatggcggaacagccaaaaccaaatatgtatacgccttaactgaaagggggaaggaacgggctgcgtgcagcccgttcccatcaaatgaaaccaaaaaagaggcaaatggaatacctgaccagaggtttgattgcggtaaagacagaacagggcgtgtttgtcagctggcgtgtttgtcagctggcgttttctcggcacggatcatgagacgacggcttttcacctttatcgggatggaaagcggatcacccgcgatccaatcgctgaaagcactaattttctcgatcaaaatggaacggctgactctgtttatcaagtggcggctgtcaataaaggacgggaagaaaagctttccaaggaagctcgtgtttggcaggaaaatgtcctggaggttccgcttgccaaaccggaaggcggtgtgacgccggacggaaagccgtacacttacagcgccaatgatgctagtgtcggggatatagacggggatggagaatatgaaatgatcctgaagtgggacccgtccaattcaaaagacaacgctcatgacggttataccggggaggtgctcatagatgcctataaactggacggcacctttttgtggcgcatcaacctcggcagaaacatcagggcgggcgctcattacacgcaatttatggtgtatgaccttgacggtgacggaaaagcagaaatcgccatgaaaacagctgacggcacaacagacgggaaaggacatatcatcggtgatgagcaggccgattttagaaacgaacagggcagaattttgtccggcccggaatatttgactgtgtttaaaggagaaaccggtgaggcactcacgaccgtggaatatgaaccgccccgcggcaagctggaggattggggagacggatatggaaaccggatggaccgttttctcgctggaatcgcttatttggatggggagcggccgagccttgtaatggcacgcggctactatacgagagccgtgctcgtggcatacgatttcagaaacggaaggctcaaaaaacgctgggtatttgactccaaccatccgggacatgaagcgtacgcaggacaggggaaccacagtttaagcgtggcggatgtcgacggagacggaaaagatgaaatcatatacggcgcaatggctgtcgatcatgacggaaccggcctgtactcaacggggctcgggcacggagacgcgatgcatgtaggggatctggacccgtcacgaaaagggcttgaagtgttccaggtgcatgaggacgccacgaagccgtacggactgtcgctgcgagatgccggaaccggtgagatattatggggcgtccatgctggaactgacgttggccggggcatggcggctcatattgatccaagctacaaaggatcgctcgtctggggaattgatccgccgggcaatgatggcatgtcgtatgggcttttcacgagcaaaggcgaaaaaatcagcgacaaagcgcccgcttcagccaatttcgccatctggtgggacggtgatttggtcagagaactgcttgatcatgactgggacggaacgatcggcaggccaaagattgaaaaatgggatgctgaaaacggctgtctgaagacgatatttcagccggccggcgtgctgtccaacaacggcacgaaaggaaacccggttcttcaggccaacctgttcggagactggcgggaagaagtgatatggagaacggaagacagcagcgcgctccgtatctatacaacgacacatctcacccgccaccgcttttacacgctgatgcatgatccggtttacaggctcggcatcgcctggcagaataccgcctacaaccagccgccgcacacgagcttttacctcggaacgggaatgaaaaaaccgccgaagcccgccctgtacatagcgggaagtaaagcggaggcaccgctgtaggaggactaagggataagacgcaaaggctgaactctacgacaagatgattaacgaacgggcaggacgaaccaatgctcaagcgctgtacgcaccggtctttttcaagggaagagctatccgtgatggaagctgtataaaaaacgagggggaatgaaaaatggcaaatcatatttatcttgccggcgattcgactgttcaaacgtatggagacagcacaaatcaagggggctgggggcagtttctcggctcgcatctgccggagcatattcaggtgatcaacagagcgatcgggggaagaagctcgaagacatttgtcgaagagggcaggcttcaggcgatcctcgatgtgatcgagccggatgattggctgttcgtgcagatgggccataatgacgcgtcgaaaaataagccggagcgctacaccgagccctatactacttataaacaatatttaaagcagtatatcgcaggcgcgcgggaaaaaggcgcccatccgcttctcattacccccgtagcccgctttcattacgaaaatggcgtgtttttgaacgattttccagattactgcattgccatgaagcagacggctgaagaggagaatgtccagctcattgatctgatggagaaaagtctcgctttctttactgagaagggcgaggaaaaagtgtacacctattttatgatttcagaagggattaatgattacacgcattttacaaaaaaaggcgcaaatgaaatggcgaaacttgtagcaaaaggcataaaggagctcggcctgccattgacagaatcgatcatcaaagaaaggtgaaaatgggatgagaaaactgtatcatggtgcttgctattatccggaattatgggatgaagagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcgcccggctgtatgaaagcgggatcgaaacgattatgtgcacgccgacgcctaccccgccaatttggttctcacacggccggcccgaacgcatgcatgtcaatgaaaaaagagagatcatggggcatggctcccgtcagcatgcctgtacgaacaacccgtattttcgaaaaaaagccgctatcatcaccacagccatcgccaaggagcttggccggctcccggggctgatcggctggcagctagacaatgagtttaaatgccatgttgcagaatgcatgtgtgagacgtgcttgcgcttatggcatgactggctcaaaaatcgctatggggtgattgagcggttgaatgaagcttggggaaccgatgtgtggagcgaaacctatcaggcgtttgagcaagtcccgcagccgggaccggccccatttctgcatcacgcctctttaagcactatgtatcagttgttttcgatggagatgatcgcttcgtttgcggatgaacaggccaaaatcatccgctgctattcagatgcgccgatcacgcataacggatcagtcatgttcagcgtggacaatgagagaatgtttcagaatctcgattttgcctcctatgacacatacgcttcgcaggaaaacgcctctgcctttttattgaactgtaatttgtggagaaatttgaaacagggacgcccgttttggattttggaaacgagtccgtcgtatgccgcctcgcttgaaagctccgcttacccgcacgcagacgggtatttgcaggctgaagccgtatcgtcctacgccttaggaagccaggggttttgctactggctatggcgacagcagcgttcaggcagcgagatttcccacggttcggttctcagtgcctggggcgaacccaccatcggctaccaaaatgtgctggcggttgagcgggcaagaaaggaaatcgagcctgttattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcaccgtgaccttattccggaaggcgctccactggacggatatcgcttgctgtttacgccatttgtgccgtatttgtcttctgaatttatcaaaaaagcttcggcattcgctgaagcgggcggcatctggattgccgggccgttgacaggagggcgcacatgcgagcataccattcataccgattgcggacttggcgaacttgagaaaacgtcagggatcaaaacactgtttacctttccgatgaatgagaacgtgaatacaggaaaagcgtttggcatcacggcgccgcttgggctgtggagcgcggtgtttgacacagagagcggaaacacccttggcacggttgaagcaggaccgggggcgggccatgcttttctgacggaacggaattacggcgaggggaaaattgtcatgctgggctcgcttccatccgggaaagaaggggatgcgatgctggaagcgctcgtcaggcattatgcggaggaagctgttatttccagccggtcggatgttacgcccggcacgatcgttgccccgcgcaaaggcgataacggccttgtgtggatcatcgtgaatatggatggaaaaggaggaagtgtgacactgccggaagcgggaacagatctgttgacgcaccgcttggaaaaggcggggaggctggcggtcggaccgcatgaataccgtgtgattcaatttgacaatcccagctgattctttgcatcgaatcagcttttttctatggagggagagaccgatgaaaaagatcaaatggttatcaggacagccaaaggtgataagcggtgtgacgtggggcgtgccatggaaaaaaggagaattaaaaaagggtgaccgtctggcgcttatgaataaaaacgcggaaacgcgatatgtgcaaagcgaaccgtcggcctattggccggacgggagcatcaagtggacaaagcacgcggcggtgtttggcggtaaggaaaaccaaaactttatcgtgcaaaaaagagaagtcccgcagccaactgaatcgctcagtattcatgagacagagcacgatatccaagtggatacaggagcactcgtttgtaccattcataaaacaggatctgatttcattcaatcattgcagatcaacggaaagccgatcgccgcaggcgggaggctcgttgcgataagagaaacgagaaaggagtcagcggcggaaacggttctttttcaagaaacgtctgtcagctttatcaaacgggcgacgattgagcagagtggtcctgtcaaagcagtagtcaaaatcgagggagtgcatgtgctccataaaacgaatgaagaatggctgccgtttgtcatccgattgacgttttatgccgggctgtctgagatcggccttgtgcacacgcagctgattgacaggagcggtaaactagaattcgttaaggggctcggcatcgaattcgacctttttttggagggagagccgtacaaccgccattttcgctttgcgggagagaaagggatgtacaaagaacccgcccagctgtttggtacacgtaaattcaatgaacgatatccgctttatgaaaaacaaatcaatggcgaaatgctgtctccagatgaagagcataaggaatggtttgcgcacggaacacagaatgcggtttgggacgatgtgaagcttgttcaggattcaagcgatcattacagcctgtcaaaacggaccggaaaagattatgcgtggatcggcatgctgcatggcagccgggcgaaggggctttgctatgcgggcggaaaaaatggcggtgtggctctcggcctgcggtatttctttgagaaatatccgtcagcactggaaatcacaggtcttgccggcagccgccccaaaatgactatctggctttggcctccggacggcgaagcgatggatttgcggcattatacaggaaacacccacgtggccagcgcgtatgaaggctttgatgaaatgcgctctgatccgacaggcattgcgaacacaaatgaaatcagcttggcgtgcttttcgcacatgccgtctgacgaagtcctcaatgcgctcgctgacaaatggcaggcgccgccgctcattgtatgcgagccggacatctattacgaatcaaaagcactcggggtttggagcatcattgacacatcccatccgctcaaaaaagagctggaagaacatctcgatgcggcctttctgttttataaaaaggaagtagagcaacgcagatggtacggtttttggcattatggcgatgtcatgcatacgtatgacccgatccggcatatgtggcggtacgatctcggcggatacgcatggcaaaacaatgagctcgttccgaccttatggctgtggcaggcgtttttccgctcaggcagagaggatatctttcgcatggcagaagccatgacccgccatacgagcgaaacggacagctttcacctcggtgaatacgcaggacttggttcacggcataacgttgtgcactggggatgcggctgcaaggaagcgagaatcagcatggccgggctttataaattctattattatctgacgggtgatgagcggacgggagatcttttgacagaagtgaaggatgccgattatgccctcgtcaaaaccgatccgatgcgcgctttttacgagaaaggcaagcacccgactcacgccagaacgggaccggactgggcggcgttttgctcgaactggctggcggaatgggagcggaccgaaaatccggaatatctcaaaaaaatcgaaacgggaatcaactgtctgaagctgctgccgctccgcttattatccggcccgacatttgaatatgacccggcgacctcgatgcttcatcatttgggagacggcattgcgggcggatatcatatgatcattgccttcggcgcgccgcaagtgtggatggagctggctgagctgcttgatgaccgggaatgggaagatatgctgagtgaattcggcgaattttacacactaagtgatgaggaaaaacggaaaaaaagcggaggcgctcttcatgacgagcattttcactggccgatgttcgccgccggtatgacagcctacgccgcgagaaaaaaacaagatcctcatctcgccgccaaagcgtggaatcttttgctagaagataagctcagccatatgccgcttccgatcaaaccggagcgcatcgagacatggacgcagctagaggagcttccatgggtgacaacgaacactgtctctcaatggtgtttaaatgtcatagcggcactggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaagggggacttacgcatcatgaaaataagaatgcgaaaaaaatggatggccttgccgcttgctgccatgatgatcgccggatgcagccattcggaaacatccaattcagcaagcgattcgaaagatacgatcaaaattatggcgccgctcttatcgccggaaagcccgagtgataagagtccttcattaaaagcgctcgaaaaatacacaggcaaagagattaaggtcacatgggtgcctgattcatcctacaacgacaaattcaacatcgtcatggcttcaggagagatgcctcacgcgattgtcattaaagataagtcagccggctttatcaaatctgtcaaagcaggggcgttttgggagctgtctccttatttaaaagactacaagaatttaagccaggcagatgaaaagattttgaagaacagctcggtgaacggcgaggtgtacggaatctacagaacgagggatctgattagggcgtgtatgatcatcagaaccgactggctgaaaaatgtcggtctggatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccggattttacaacgaaggaatacatggatgcgctcacgttttttaaaaagctctatgatgagggattgatcaataaggactttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcaccttcccgacatctggttattcaggcatgatcacgataccaaaatcaagcgtcaaaaccgaaaaagagctgaaagaggtgctgtccttccttgataagatgaatgataaggaagcgcagattctcacgaacaacggagtgaagggccgcaattacgagctcaaggacggcgtattcacctcacttgaaaaaaacaataaatctctcctgtatgagcatgaaggcttggcacagttcagcatgtcgattccgaaaagcgagtattacatcgaagaccagaaaaccaagctcttccagcatcgcaaggacatcataaccgaaggagaaaaaatagccgtctttaacccggctgagtcgcttgtatctgatgtctatacccaaaaaggagcccagcttgacaacatcattctcgacgcgagaacacaatttatcattggagaaattgatgaaaaagggttcgatgatgcggtggagctttggaaaaaaagcggcggcaatgaactgatgaaggacttgaacaaattgtaccaatcgtcaaaataaaccgatgcgcctgcctttcggcgggcgccccggtatcacgaaaggagaacagatatggaaacagtgccgaagaagggagatgcacctgttctcaccgctggaaaaggcatcagctggatggctgcgctcaaacgggacaaatggctttatcttcttcttattcccggtctgctttatttcttgattttcaaatacttgccgatgtggggcgtgctgatcgcttttaaagactattcgccatatctcggcttctggaaaagcgaatgggtcggctttgattatttcaaagacttttttatgaatccggattttttccggctgctgcgcaacaccctcatgctggcgagcctggatcttttgtttgcctttcccgcgcctctcattttggccctgcttttgaatgaggtaagaaaggccgtgtataaaagatgtatccaaacctttatttacgtaccccattttgtatcatggacaattgtggtcagcatcaccttcgttttctttactgtcgatacaggtgtgatcaacaaattgattatgagcctgacaggtgagcagatttctttcttgtcggatgcagactggttccggccaatgattgtgatgcaaagcatttggaaggagacaggctggggaacgattctatttttggcagcgcttgctacggttgatcaagagcagtatgaagcggccatcatggacggagcggggcggttcaggagaatgtggcatattactctgccggcgattagaagcaccattatcgttttgttgattttaagaatcggcagctttttgaatctaggctttgaacaggtgtatttgatgacgaactcgctcaaccgcagtgtggctgacatcttcgacacgtatgtgtacatgatggggattacccaaggggcgtatagctacagcacggcggtcggtttgtttaagtcagttgtcgggattatcttgatttttggcgccaattacattgcgaaaaagtttgatcaggaaggattgttttagaggagggagaggtatggctgaaattcacacgatgcacaacaccaaagccggacgggtgtttgacgtctgcaacattctgtttctcggcggtgtcggcgcgattaccattttgccgtttttgtatattatcgccggttcctttgcgacagaagcggaactcgcccagcggagcttctttattttcccgaaaacctttacacttgatgcttacaagtatgtgttttcgacaccgacgttccttcgaagcatgggtgtgtccatcttcatcaccgtggtcgggacggctgtacagctgtttttcaccttcacaatggcgtatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccagtcatagcgacctttgcgctgttttatgcggtcgggatttggaatgatttcttccacgctctcttatatatcaatgacagtgcaaaatggccgctgcaaatggtgcttcgccaagtcacgattttatcggatttaacggcgaccaatggcgatacgatgcaaaatgccgttccgccggagcagggaattaaactcgctgtcattgtcatagcgacgctgccgattttggcggtctatccatttttacaaaaacactttgcaaagggaatgctgatcggttcggtgaaaggctgagaaagggagtgtttcatatcagtacattagatcagattaagattgcctatatcggcgggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgcggatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtcccgatatttgcggaaattgcccgggcaataagagactacgcacctgaatcatgggtcattaattatacaaacccgatgtctgtctgtacaagagtgctgtataaagtgtttcccggcatcaaagcgattggctgctgccacgaggtattcgggacgcaaaagttattggcggaaatggtcacggaaaggctggggattgaggtgccgcggcgtgaggatatccgcgttaatgtgctcggcattaaccattttacatggatcacaaaagcctcttaccgccatattgacctgctgcctatattccgtgaattcagcgcgcactatggggaatcaggatatgagctggagggggaaagctggagggacagcgtcttttgttcggcacaccgtgttgcgtttgatttatttgaaacgtatggcgccatccctgctgcgggagacaggcatctggcagagtttcttcccggcccatacctcaaacagcctgaagtatggaaatttcatctcacacctatatcattcagaaaacaagatagagctgagaaacgacaagaaacagaacggttgatcgtgcaacaacggggcgttgctgagaaagcttcgggagaagaaggcgtgaacatcatagcggctcttctcggattgagtgaactcgtcacaaatgtaaatatgccgaatcaaggccaggtctcaaaccttcctatacaagccattgtcgaaacaaacgcattcatcacaaggaaccgtgtccagccgattttgtccggagcgcttccgaaaggtgtggaaatgctggcggctaggcatatatccaatcaggaggcagtggcggacgcaggtttaacaaaggatgctggcctcgcgtttcaagccttcctcaatgacccgcttgtccagattgaccgcagtgatgcagagcagcttttcaatgacatgctccaattcaccatgcaacgttgagcggagcttttccggtttagaaaggaaagcattgaccatactgatagtataatcaagaagtaggtgctatcaatatgggaaattatttaagcgttgcggtagaactggtctgcggtctaggcattttatttatcatcttaaagcttctcgggaaaacccaattttctcaaattacgccgtttgactttatttctgctttaattttaggtgaattagtcggaaatgccgtctacgatcatgaaatcaaaatcaaagaaattatttttgcttcgctgctgtggggcgtgctgatttatattattgaatttatcacgcaaaaaatgaaatcatcgcgaaagttcttggagggtgagccgaatatcgtcatccgcaaaggagagcttcaatataaagtaatgaagaaaaataagatagacattaaccagctgcaaagccttttgaggcaagccgggagcttttcgatccaagaagtagaatatgcgattttggaaacaaacgggatggtcagcgtgcttccaaaatccgactttgacaaaccgaccaataaggatttgcagattccttcgaagtctgtttccctgccgatcactttaatcatagatggagagattgtccgggataatctgaaggaagcaggtgtggatgaacagtggctgaagcaagaattgaaaaagaagaacattgataagacggaggacgtgttatttgcagaatggcataaaaataagccgctgtataccgtaacatacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttgtggccggcgatatgcgcatcgcttttttcccattgcttccagcgatcctctgattcccagcgaatcatgacaacaacttcctcatcaccgcggcgtacgtttttctcaagcactgtcacatcaattaaaccttcttgtttttcaatgattccttcagcgctgaaacgttctatgactttatctgcaaagccttctttaaccgtcatttttcttaactgtacaaacatttgtctcactccaatcattctcacatatgaataattgtaaatgaaattcattctcaatgtcaaagaaagcgcagggcggaatcgaaccgccgtgcgcaacagtttattcttttaataaaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggctccttttggcgcaacctccagccagcttgcttcaggtcccatcgggtggtccgctgcaatatcaaagcctaccttctctgtccaaaattgcttcgctttctgctggtcctcgacatatacagcaacagtgccaatttgtttgatcatagggaaacctccaagttgaaaagataataatactataacctgtttacggccgaagtaacataaaaaaatcagccgggaaaccggctgattattaaaatgagcagcttacaacatcgatgtgatttgtgtctaaggcgaaataaacccagcggcgccgtgaggaatcccaataaaagccgccgacggatcttctgccaaggatgatcgggtaaaaccaaaatgagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaagcctggaacagcgccaccgccaataccagggccggagccgccgccaaagcctggaacagcaccgccgccaatgccagggccggagccgccgccagagcccggaacagcaccgctgccaatgccaggccatggatatcggtattcatattcaaaagcaggccaaggctcataaaaatgccccgcaaacatataaggatcaacataatacatgtgataacgtcctttctcattgtaaactgtacactgcagtttatgcgggcggactcttattggtgcattcgcctaaggatatgaagctgaaatgctctcagagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagacaacatgacaaaatgggcggaaaacgttgcgaaaaacagggtagagcaggatgttcaagttcatgaggtcgtagaagccatatccaactctagaatctcattctgggacgcagtcgtcacatttataaaagagaatcaggagatcgtgacaaatgaggatgcagaccgatggaaccgcattgtgaatcagtcgttcgataagctgattattgaattctctgagcagtaccaaaaattcatgctgatgaggctcacatctcagcaggaactgatctcagagcttggctgcccggtcatttccattgccgatggaatcgggatattgccgcttatcggctccattgatacaaaacgggcacaggtcattttagaaacagtgccggtccgctgtgtcgagagaaaaatcacaagcctcgtcgttgatctttcgggtgttccgattgtggataccatggtggctcagcaattgtacaacctgtctaaaacgcttttcttattaggcgtcaaagccgtattttcagggattcgcccggatgtggcccaaacatcgattcaattggggcttgattttagtgaatatgaaacgtacggcacgctgaagcaggcattagaaaatatgggtgtccgctgtattgttgaggaattggaagaaaacaaataggaagtttccaggcatatgattgtccgtcaccgggtgatcatatgcctttttgatttgaacagaaatcaccattgatttatcaaaaaaaacataatattataattcttataagaatactgtgaattaaaacctattcaacaggggggaaggtcttttggtttcaaaatcaacgattgatccggaagtgattgaaaaaatcatcagctcgctggaaacactcgatttcggcaccgttcaaattacggttcatgattctcagattacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtctttactttgctgatcgcgactgtcggcctttttatcggccaatttgttcctgtcgctttgatgctgccgctttctattcttgaagtggtgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgcttgaagcctttggttctacatttgtcatttttgccgtcttaggcacaatcggcgcaaaaatgaagaaggatttatccttcctgtggtcatttctgctggttgcggtgctcgccctcgcagtggtagggattttcaacattttcagcccgttaaactcagcggcgatgatggcgtattccgtgatcggaaccatcgtcttttccctttacattttgtatgatttgaatcaaatcaaacaccgccacattacggaagacttgattccggttatggcgttatcgctgtacctagactttatcaacttgttcatcaacctgctccgcttcttcggcattttgagcagtgatgattaatgaaaaagcgcctgtctttggataggcgctttttttccatacataaaaagggcagatggagtgtttatgagtatcctatcattttaaatacgctggagcaggtcacagtgctggagccatggtacgaagacccgtcatcatcggaggagacgccgcccacgccggtgcgccaaccctggcacaaggagcggcaatggcgatcgaggatgccatcgtcctcgccgaagaactccaaaaccacgccgaccacgaaacagcattacaggcgtactacaaaagaagagccccacgagcgctcaaagtccagaatctatcttcagaaatcgtccgccgcgggctgaaaggagagccgggagcggaagaactgattggggagtgctatgcggtgttgagggaagggtattaaataggaaaagtccagaaagtgatttctggactttttagtcttgctctgttttattccttatccgctcaatcacctcatgcagcccctcaggcttataaaactccaccggtgaactgcctttctcaaacgaaatcgtctcggcttcaatcagcgcgacatagcgcccgtttacttttgcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgtttttcgcttgcttcccaaatctcaatgtcgtgctcgaactgcttgagttcttcgctgttgtcttcaaatgtctcgtagacgtgctcttgtaccatgttcatgacctgatttttcatgatttctggcatcgattctccgtactcgacgaatttcagaaagtcctcaaaatagcgggcgtgtgaggcctggtggattttcagttcaccttcctcgaccattccttcctctggcatgtacgggtattggatgcttttcatgttttttgtcgtgatcgccatttcgacttttttaatgagagaagacgcgtcagagatgcgggcgaccttcggctcaaaatcacatttcataatgaagacaaatgactcgtcaaagtattttctcggtacggccgaagcgacgagaaacacgccgccgcgaaccgcgcttgtgtcaaggtacgtgcggacgaactgctcgctcagctcattgaagtcttcttttgtttccgccagacgcgcgcggttgaacatgttgtagtttgggttggaatcgagctcgtggccgggctcgacgataaaatggccgattttcgtcggcacctgctcggactgcggatggcggtctgctttccgtttgacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcgatcatgcgtcaattgggagaacggaataatcatgaccatgaaagggaaatgtagtcaaatagaaggcatctcatacggaaaggaatggttcgatgaaggaaacaagcccgattcctcaaccgaagacgtttgggccgctcggcaatttgcctttaatcgataaagacaagccgacgctttcgctgatcaaactggcggaagaacagggcccgatttttcaaatccatacacccgcgggcacgaccattgtagtgtccggccacgaattggtgaaagaggtttgtgatgaagaacggtttgataaaagcattgaaggcgccttggaaaaggtccgcgcgttttccggtgacggattgtttacgagctggacgcatgagcctaactggagaaaagcgcacaacattctgatgccgacgttcagccagcgggccatgaaggactatcatgagaaaatggtcgatatcgctgttcagctcattcaaaaatgggcaaggctcaatccgaatgaagcagtcgatgtcccgggagatatgacccggctgacgctcgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaagcggcaattccgccatgatattcaaacgatgttttcgttagtcgacagcattattgcagagcgcagggcgaatggagaccaggatgaaaaagatttgctcgcccgcatgctgaatgtggaagatccggaaacgggtgaaaagctcgacgacgaaaatatccgctttcaaatcattacgtttttgattgccggccatgaaacaacgagcggcctgctttcctttgcgacttattttttattgaagcatcctgacaaactgaaaaaggcgtatgaagaggtcgatcgggtgctgacggatgcagcgccgacctataaacaagtgctggagcttacatacatacggatgattttaaatgaatcactgcgcttatggccgacagctccggctttcagcctttatccaaaagcagacacagtcattggcgggaaattcccgatcacgacgaatgacagaatttctgtgctgattccgcagcttcatcgtgatcgagacgcttggggaaaggacgcagaagaattccggccggaacggtttgagcatcaggaccaagtgcctcatcatgcgtacaaaccattcggaaatggacaacgggcctgtatcggcatgcagtttgcccttcatgaagccacacttgtgttaggcatgattctaaaatatttcacactgattgatcatgagaattatgagcttgatatcaaacaaaccttaacacttaagccgggcgattttcacatcagggttcaaagccgtcatcaggaagccattcatgcggacgtccaggcagctgaaaaagccgcgcctgatgagcaaaaggagaaaacggaagcaaagggtgcatcggtcatcggtcttaacaaccgcccgcttctcgtgctgtacggctcagataccggcaccgcagaaggcgtcgcccgggagcttgctgatactgccagtcttcacggcgtaaggacagagacagcacctctgaacgaccggattggaaagctgccgaaagagggagcggttgtcattgtgacctcgtcttataatggaaaaccgccaagcaatgccggacagttcgtgcagtggcttcaagaaatcaaaccgggtgagcttgagggcgtccattacgcggtatttggctgcggcgaccacaactgggcgagcacgtatcaatacgtgccgagattcattgatgagcagcttgcggagaaaggcgcgactcggttttctgcgcgcgggaaggggatgtgagcggtgattttgaagggcagcttgacgagtggaaaaaaagcatgtgggcagacgccattaaggcattcggactggagctgaatgaaaacgccgataaggaacgaagcacgctaagccttcagtttgtcagagggctgggcgagtctccgctcgctagatcgtacgaagcctctcacgcatccattgccgaaaatcgtgaactccagtccgcagacagcgatcgaagcactcgccatatcgaaattgcattgccgccggatgttgaatatcaagagggcgaccatcttggcgtattgccaaaaaacagccaaaccaatgtcaaccggattctccacagattcggtctgaagggaaccgatcaagtgacattgtctgcaagcggccacagtgcggggcatctgccattgggccgtcctgtcagcctgcatgatcttctcagctacagcgtcgaggtgcaggaagcagccacaagagcgcaaatacgtgaactggccgcttttacagtgtgtccgccgcataagcgcgaattagaagaactgacagcagagggtgtttatcaggagcaaatattgaaaaaacgaatttccatgctggatctgcttgaaaagtatgaagcgtgcgacatgccgtttgaacgatttttagagcttttacggccgttaaaaccgagatattattcgatttcaagctctccaagagtgaatccgcggcaagcatcgatcacagtcggtgtcgtgcgtggccctgcgtggagcggccgtggcgaatacaggggcgtggcatcaaatgatttagctgagcgtaaagccggtgatgatgtcgtgatgtttgtccgcacaccggaatcccggtttcagcttccagaagatcctgaaactccaatcattatggtcggaccaggcaccggagtcgcaccattccgcggtttccttcaagcccgcgaagttttaaagcgggaagggaaaacgctcggtgaagctcatctctattttggatgcaggaacgatcgtgattttatataccgcgatgaacttgagcagtttgaaaaagacggaatcgtcactgtccacacagccttttcccgcaaagaaggcatgccgaaaacgtatgtccagcatgtaatggctgaccatgcagaaatgttaatatcgatccttgaccgcggaggcaggctttatgtatgcggtgatggcagcaaaatggccccggatgtggaggcggcactgcaaaaggcgtatcagtctgttcatggcaccggggagcaagaagcgcaaaactggctgagacatctgcaggataccggtatgtacaccaaagatgtctgggcagggatatagataaagaagactgggaacatccagtcttttttgtcctttagaaaaaatggtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttccgagaaaaaaatgtgaaacgaaatgaaggtttctttcgtccagtgattggtttccaaatggttgtaataaaaatgatatggtgcgaaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtccggaaacgttggaaacatgggagacgggattttcagtatcatggccggtcatgatattttctatttcttagatattatcattttgattgcggtattgatctggagacctgaattaaaagaatacaaaatgaaaaaacgctttgcatctttagtgatcctttctgggatcgcactgtttttcatcaacctgcactatgcggaaaaagaccgtccgcagctgctgacaagaacgtttgaccgcaattatattgtgaaatatttaggtttatacaactacaccatttatgacggtgtacagacggctcaaacagaaacgcaacgggcctatgcaagcagcgatgatttaacaagcgtcgagaattacacgacgtctcattatgcgaaaccgaacgccgagtacttcggctctgccaaaggcaaaaatatcattaaaattcacctcgaaagcttccagtcattcctgattgactacaagctaaacggtgaagaggtgacgcctttcttaaataagcttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacttaccagtcgcttcctgcgattttagaccagaaggaaggctatacaagcgccgtcctgcatggtgattacaaatcgttctggaaccgtgaccagatttacaaacatatcggatatgacaagttcttcgacgcaagcacgtatgatatgtcagatgaaaatgtgattaatatggggcttaaggataagccgttctttacagaatcgattccaaagcttgaatctcttaaacagccgttttatgcgcatttgattacattgacaaaccattatccgtttaaccttgatgaaaaagacgcgtctcttaaaaaagcgacaacaggcgataacacagttgacagctacttccagacagcgcgttatcttgacgaagcgcttgagcaattcttcaaggagttgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgttatgccgacacttctgcacttagaaggaattgattctcagaaatatatcaactttggtactgatttattctctaaagaccacgacgatacggtggcattcagaaacggagacttcgtaacgccgaagtacacatcagtcgacaatatcatttacgatacgaagacaggtgaaaaactgaaagcgaatgaagaaacgaagaatctgaaaacaagagtgacccagcagctgagtctttcagacagtgtcctgtacaaagacttgctgaggttccataaactaagtgatttcacagccgttgatccgtctgactatcattacggcaaggaaaaagaaatcaaataaagatgagaaagagccttgagcgggcgcattgccttcgctgaaggctcttttttttggttacataaccaacttcaaaaaatagattctatttggtcaccaaggccgtctttctctcatatcattacagtagattttgaaaccggattgaaatcggacaaattatcggggaaatgccttgatagattgtgaagatgtaccaggtttcgaactcaatattcatagagatgaggggtagagatgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgcttttgggctataaaggagaaaaaatcaaggaatactttctcgactatgaatggaagcacaacagcctgacactcgacagctctacgggagaggtacagatgctggggcagcctgaaacgtggaaaattacgtttttggagactggggaagatacgctgacagccggaagaatcttgcaggcgaaagactatatcggtgatgaaacatttctgcttacctatggggacgggctggccaatatcaatcttttccatctcatcagctatcatcagacaaaaggtgctgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgattatttgccgaaggacggaaacacgatgttcgaagatgaaccgctgaagaaccttgccaaagacggggagcttgctgtgtaccgccattacggattttggacggccattgatacgtataaaaatctcttagaagtcaacaaaatgtggaatcaaggacaacaagtatggaaggtatggtgaatcgatttgagtttctggaaaaataaaaacgtatttgtcacgggatgcacaggtcttttaggaagctatttggtgaaagagctgattgaacagggcgcaaacgttacggggcttgtcagggatcatgtgcctcaatccaatctttatcagggagaacatatcaagaaaatgaacatcgtgcggggctctcttgaggacttggctgtgattgaacgcgcgcttggcgagtatgagatcgacactgtctttcatcttgctgcacaagcgattgtcggcgtggcaaaccgcaacccgatttctacctttgaagcgaatatcctcggcacatggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggtacctttgtacgggactacttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacactattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagcaagttgatcaagacagtcccatttttatactttgcatggatgaagatacgcaccgcgtgttacagaagctgaagatgaagcagctgaaccttgtgccggtggccgctcttgaaaatgaattgctgctgaagctgaaggaaactagagatcaaagtgagtattgctggacgatgaagccgatctttctgcaagctgtgctgaacagcaatcctgagctggagcgtgtgacgtatattgacggggatctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttatcagcttcaagcatgatgatgcaggcacggattgcttggagtggtggaaggaacgctgtcttgaggaatgcaaaaatgcaccgggtgaagggaaattcggtgatcagggctatttggattatatgtctgagctgtttccgaatgtgtgtgacattacaacacccggcgtgaacattgggcattggaattatgggcatcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatgaaaacgttagaccctgaatttaacggttttgcttcaaaagatgacaacaaataaatgagtaaatacaggaagtgaaaatgaagtgaaagcaagcgttattattcctgcatataattcgaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttattatgaacggtttgaagaagaacataaggaacagctcgcaaagctcacaggtgaaatgccgaagaaagacaaacaaaagctgctggaggaagcggacatcaaaaacggaagctttcttgataaaagctttgacctcgataccgactttatagacgtgctcaagaagattttagatgagtacggcgatgacttgaaaggctatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgcgatattgtcagtgttcatcaggaacatccaagcaattgtaagtctgtagacgatattcgggcaaacattgcctatatgtgcgataaatacaataacatccgctccttagacgttcatctcgcatttaatgggccgttcccgcctgacatgacgaacagaatcatggctgatattcaaaagctgctggaatcacagaaatatgatatgctgctgaatctgtttcttgagcttctgcatgttgttaaagagcgcaacattgatccggattggagaaagaaatccccaagggtgacggcgaaaagctttgatttacaaactgtccgcaagcttctgccgaaagcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcatgttccatgggagcatgtcacctttgtgcagctgcatgaaatggaagacccggagctgctgaaagcgaaaagcaacagaacgtttcatgaatattgctggacgttaaagcccgcctttttgtttcatgtgatgagcaagtgggatgacgctgaatactttgcccatatggatacggatctatttttcttttctgatccggcgcgtatttttgcagaaaacccaacggcgtctctgtatttgactgatcatcgtaactcgccgcgcttcatgtcctactacgaccgaaccggacgctttaatacaggctttgtcggtgccggtaatacaaaggaagcatatgaagcggtgtggcagtggagacaggactgtattgaattttgtacggtcgaaatggatacggaacgaaagacatatggtgatcaaaggtatgtggagaaatggccggcgcagtttaaaggtgttcatgttgtcaaatcaataggagccaatacagcgctttggaatatcgaaaactataaggtcgggcaaaaggacggccgcgtgtatatagatgaaacgccgctgattttctatcatttctcagggtttacactggtgacagaaaaagagtttaatctttgctggtactaccggattgaagacgaagcgacaattgagatgatttatatgccgtatatattaaatctgaaaagatggattgatgaaatacagtcggcgtttccggactttgcggatggctttatcccgaagcacgcagtgcctgacactcattttatccagctggattaaaaaacccctgccgcctggcaggggttttttcagctatgccattctctcagcttctggtcactcggcaataggaaggcaaggatgccgagaacagggagaaaagcaatggcgatcatcgtgggggtcagtcccgcggcgtcaatcagagcgcccagcgccacagcgccgattgcgcccatcccaaaggcaagcccgacggttaaaccggacattgtgccgatttttccaggaactagctcctgtgcgtagacgaccgttacagaaaagctcgacatcagaaccaagccaatcaatgcgagcacgccataggcgagaaccgggccggcaaatggcagcacaatcgccagcggcgccgagcataacagcgaaccgaggataacgaagcgttttccaaaacggtctgcaagcgggccgccgagaaacgtgccgattgcgccgaacagcaagaagacaaaaatatagctttgtgcctgctgaatgcttacgtgatatgtatccatcgcgtaaaacgtgtaaaagttaccgatcgcactcgtataccaagaacgagcaaaaatgagaaatataataataataagagcagatacaacagatttggtgatggccgtgttttcagccgttttcttttgcttgcctgatttctgggcaaggctgccgagacgtgaggcgtaccatttcgcaatatacatgagaaacaaaacagcaagcgcggcgacgagcgtgaaccaaacagcgccgaattgcccgagcggcacaaggatcagcgcggtgatcagcggcgccatcgcctggcctgagtttccgcccacctgataaatcgactgggcgagcccgcgttttgtgccggcggccatatacgccacacgggagccctccggatggaaaatggccgagcctaatccaatgaaaaacacacagcataagatcgttatgaatgacggggcaaatgcaaggcctaaaatgccaagcatgctggcggtcaaaccgactggcagcgcatacggccgcggccgtttatcggtataccagccgacaacaggctgcatgacggatgacaccatgtttaatgtgaaagcgatgatgccgagctgtgtaaacgtcaggctcatggagcgttccaaaatagggaacatggccggaatcacagcttgaagcgaatcgttgagcatatggcagattccgataataatcaaaatcggatacaccgtggtgcctggtttttgaactgttttttcttttaacggggcggcgatagccaattgagtctcctccttacatatataaccaaagcataccaccatattattcataaggtgaagaatttatcaagaggaaaaaagactcttatgaaagaaacgccgtcagcctgattagcagctgacggtattttcgatattcaaaatgtgatatagctcttcaagcttacgaatctcataggttggtatgatctctggcacattcggcttcatgtcagggttcatccagcaagtatcaagcccggcgagctgtccgcctttgatatcagcagttagtgaatccccgatgattaatgtgtgctctgctgaaaattgaggaatccgttcaaacacgtaatcgaaatattccttcatcggcttttggaagcctgtgtcttcagaaacgaaaatgtccttgaagaatggaaataatcctgaatcacggaggcgcttatattgtgtgttagacacgccgtttgtcacgatgtacaaatcaaactgttgctgcagatttgagatgagatcaaatgcaccgtcaataagctgatgtccttcttcaagaaagcggcggtatttttgctcaagcaaggcgccgtccgcctcgtaaccgtactccttgagcaaagcggaaaaacgcgtgtttacgacttcatcccttgtcatcttaccttcttcaaaggctctccagagaccttgattgatggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgtttcatctgtgtgtctccctttcctcatatgtattcaaagtatagcacataaaaaaaggaaaaagccggcgggtgaggcaccgccggctaaaaagagattatttgtttaataagctgtgttttctcgaatataggaagtaaaccagcgttccgacagcgatccagatgacaaatgaaagccatgtgacgccgggaaggctgtacatgaaccaaatgcagatgcctgcgctgataatcggcacaaccggaacgaacggcactctgaaggacgccttgatttcaggatgtttctttcttagcacaatgacagcaatagatatgaccgtaaacgcggcaagtgttcccatgttcaccagatgggccagcgttccgaggttaataaagccggcgattcccgctgcaacgattcctgtcagccatgtgttgcggaacggggttttaaatgacggatgaacctttgcgaacaatccaggcagaaggccgtctctgctcatggcaaatgtcaaacgaacctgagcgtacagcaaagcgagcatcaccgtcgtaatcccgataatcgcaccgacagaaataattccggcaacagcgtcctgtccgacgaatttcagcgcaaaggatacaggatctccgacattcaatttggcataaggcatcatgcctgtcagcacaagcgataccgcgatgtacagaaccgtacagacggctagagctgaaataatgccgacgggcatgtttttttgcggatttttcacttcctctgaagcgttagaaaccgcgtcaaacccaaggtacgcgaagaatacagtggcagcgctaagaatgacgcctttcatcccgaatggcataaaaggagaccagttgtccggtttcacatagccgataccgacaataatgaacaataaaatgatcgcgattttcatcagtacgatgacgttgttaaagcgtgtgctttccttgacgcctctgctgacaatcgcagtgatgaggagaatgatcaccgcagccggaagattaaatacggcgcccgccgtgcttcccggcgctcctgtcagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtatgagtatacgcttcccgaaatcggaattgaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaagcggtttttttctaaataatgaactcatcaaaagttcctcctggaaatattcaaaatattctaatcattatatacagttcttgttgtattatattgtcgaaatttgacgcagtcaataaaatatttttctgctttaaatgatagaagcgaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgtttgagaaaagaaccattttagaaaaagccgtcacgtatattgaagaaaatgaagaagccattatttatttgattatggaggagctaggcggtacaaggctcaaagcggcttttgaaatcggacttgtcaaaaacatcatgaaagaagcggcaacgttcccaattcgcatggaggggaaaattcttccgtccacaatagatggcaaggaaaacagattatatcgcgtgccggcaggcgttgtcggtgtcatcagtccgtttaacttcccattctttttatctatgaaatcagtggcgcctgcactcggagccggcaatggcgttgtgctaaagccgcatgaggaaacgccgatttgcggcggaacgctgattgcgaaaatttttgagaacgcgggaattccagcggggctgctgaatgttgttgtcacagacattgctgaaatcggcgacagcttcgttgagcatccagtgccgcggatcatctcatttaccggttctacgaaagtcggcagctacatcggacagcttgcgatgaagcattttaaaaagccgcttcttgagcttggcgggaacagcgccttcatcgtacttgaggatgcagatatagaatatgcggtcaatgcggcggtgttcagccgatttacacatcaaggacagatttgcatgtcagccaaccgcgtgcttgttcattcttctatttatgacaagttccttgagctgtaccaggcaaaagtggaatcgctgaaagtcggcgacccaatggaccctgatacgattatcgggccattaatcaacagcagacagacggacgggctgatgaagactgtagagcaagcaattgaagaaggcgctgtaccagtgaagcttggcggatttaacgggacgatcgtggaaccgacgatcttaaaagacgtcaaaccgttcatgagcattgccaaggaagagctgttcggaccggtcgtctcctttatgaagtttgattcagaagacgaagcggtggatatcgcaaacgaaaccccgtttggcttgagcggtgccgtacatacgtcaaatcttgagcgcggcgtggcttttgcgaaacgcattgaaacaggcatgattcacgtcaatgacacgaccatcaatgatgaaccgaatgtagccttcggcggtgaaaagcaatcaggcctcggccgtttaaacggtgagtggagcctcgaagaatttacaacgctgaaatggatctcggtccagcacgaaaaacgcagattcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggctaaaaccttttcgctgaacgtaaaagccggcgatccgctgcaggaaggggatatcatcacagatgccatccgcagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtggcggaaagcttatcagctgtcgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctcggaccaaagcaatctgctcggcttgaatgccgcgatcgaagcggcaagagcaggggagtccggaaaaggcttctctgtcgtcgcagatgagatcagaaagctagcaacgcattcaaaagaaaatgtcggccaaattgaccagattacgaaaaaaatccacagcctgctgaaagggctcgaggaatccattgagtcgattaaccagcatacagacggacaagccgctgctgttgaacaaatttccgccacgatgcaggagatttcaggaagcgcgcagcatcttgcaaaaatggccgaaaaagcgcttgaggaagagtaagagaccggggacaaatgtccccggtctttttctatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaacaggaaaatcaacgctgctgaaagtgatttccggcttggaatctatcgaagaaggagaaatcacgaaatctggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcaaacaatgcatgggatgcaaacaccttggcaaaaaccgtattgtctaagctgggcgtcaaagacgtaacaaaaccggtcaatgagctctcaggcggccagaaaaaacgggtagccattgccaaaaacttaattcagcccgctgatctgctcattttggacgagccgacaaaccatttggataatgaaacgattgagtggcttgaagggtatttaagccaatatcccggcgccgtcatgctggtgacgcacgatagatatttcttaaaccgtgtcaccaaccgcatttatgagcttgaaagaggaagcctctacacgtacaaaggcaactatgaagtgtttttagaaaaacgcgcggaacgggaagcgcaggctgagcaaaaggaaacgaagcggcaaaacctgctgcgccgcgagctggcctggctcagacgaggagcgaaagcccgctccacaaaacaaaaggcgagaattgaccgggtagagacgcttaaagagcagaaaggccctcagtcatcaggttcactcgattttgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaggtcattgactatataaaagaaacagcggaggtcgtaaaaacggcagatggcgatatgattacagctgaacaaatgctcgagcgtttcctcttcccgcgttcgatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccagttcccaggcgtcgtcatcaccgtatcccatgaccgctatttccttgaccgcgtcgtcgaccgtttgattgtatttgaaggaaatggtgtcatttcccgctttcaaggctcctacagcgactatatggaggagtcaaaagcgaaaaaagcggccccaaaaccggcagctgaggaaaaatcggctgaagccgagccgaagaaaaaacggaaaaagctttcttacaaagaccagctggaatgggacggcatcgaagataaaattgcccagctggaagaaaagcatgaacagctcgaagctgacatcgccgcagcaggcagtgattttggcaaaatccaagagctgatggccgagcaggcgaaaactgcggaagagcttgaggctgcgatggaccgctggacagaattgtccctcatgattgaagaactggaaagctaaaaagcgtggccgcagcaggccgcgctttttttcacataatggacaaaaacgaatcggcctgcttatgttaggataaaattgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcggcaaatttgaagtgcacgccaagctgagtgacgaaaatgcgagtctctctctagatggaaaacgcctcgagggtgcagagaagcagaaagtgattgatcaatttaacgaagctatcttcctggaaaaatattatatctatccaggtgatgaagagcgttatttacatccggaaaacggcggcacgccgctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaaacaggaaagtgaaagacgggtgctttatgctgctcgtcttttttattgttttttaaaacttaacgtttacgttaaggttcaaaaggtgtataatggtaacagaaacggcgaagggggatttaccttggaatggatgaagattgatcaagtggccaaaagaagcgggctgacaaagcggaccatccggttttatgaagaaatcggcttgattccggcgccgaaacggacagacggcggtgtaaggctttattcagaggatgatatggaggagcttgagaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctggatttgattgatgagaaaatccgcacattccaaagctttaaagaacgcctgcagggcatgaaaaataaagcggaacgcgccattcaatcaatcgaatgaaaagtttgccaaacgctatttttgtagcgtttcttttaatggaataaagatggaggtcaggtcaaatggataagacaaaacaagtgaatcagaaaacaggcttgctcagccagccgaaagcggtttgggctgtcgcgtttgcctgtgtgatttcctttatgggaatcgggctggttgatccaattcttccggccattgccgcacaattacatgcttcacctagtgaagtatcactcttgtttacaagttatttgcttgtaaccggatttatgatgtttttctcaggagccatttccagccgcatcggcgcgaaatggacattaattctcggacttatttttattattgtgtttgcggggcttggcggcagctcaagctcaatcgctcagttagtcggctatcgcggcggctggggattagggaatgctttgtttatttcaacagcgcttgcggtcatcgtcggcgtgtcagtcggcggcagcgcccaagcgattattttgtatgaggccgcgctcggtctagggatttctgtcgggccgcttgcaggcggagagcttggaagcatttcatggcgcgcaccgtttttcggagtatctgtcctgatgtttattgcgttaatcgcgatttctttcatgcttccgaagctgccgaaaccggcgaagcgcgtcggtgtgtttgatgcgatgaaggcgctcaaatataaaggccttttaacaatggcggtatcggcattcttatacaactttggattttttattttgcttgcttattctccgttcgttctggatttagatgaacacggtcttggatatgtcttcttcggctggggccttctgctggcgattacgtcagtctttacggcgccgctcgtgcacaaagcgctgggcacagtgcgttcgctcgtcgttctctttatcgcctttgcggccattctcgttattatggggatctggacagaccatcagactttgattattacatgtatcgttgtcgctggtgctgtcctcggtatggtgaatacgatcatgacaaccgctgtgatgggttctgcgccggttgaacgttcaatcgcgtcttcagcctacagctcagtccgcttcatcggcggcgcgctcgccccgtggattgcaggaatgctgtcagaacactttactgcaagcacaccatatacagtaggcggaatcgtcgtttttgtcggcatgcttgtccttctcatgggacgtaaacatcttgctggaattaaggcgggacattaataacgaaagacactgcgaagatgcagtgtctttttattcgttataatgcatcataatcgaattggtgaaggaaaggacaacctttatgacacaattttactatttttcgactgaaaactccctttagaaaccggttttttcggtcagcaagaacggcgttcgcggaaagggcatccgcttcggtcagacattgatgcggctgggatttatcttgcagaagctgagaatgtgtccgttcatttacgattgccatttcaagtgatggtttatgctgtagaggggacgtttgccatggataaggcaaaacctgacgaatatgatcataaatgtttagaaacgctctatcaatacatacacagcgtcatgaaaaacagcttttctcggtcgagtggtttaccgcttgggcagatgaggaggattttgagctgtctgccaaaagagagctgacacttgatgaattcacctcgccatagcagctcattttaaaagacagagagcttttgagaatcgttcagaaaaaatggcagtaaaaaacccgccctttagcaggcgggttatttataaattaaagcactttcgtcgtccaagactcgcagttccacgtttctgtcgcaatatccatataaaagtctggctcgtgggaaatgagcagaatggagcctttatattctttcagggcgcgcttgagctcttccttggcatcgacatccaagtggtttgtcggctcatcgagcaccagcaggtttgtttctgagttgattagcttgcacaatctgactttcgctttttcgcctccgcttaatacggagacgcggctttcgatatgctttgtcgtcagtccgcattttgccagagcggcacggatttcatactgcgtataagaagggaattcgctccatacttcttcgatgcacgtattgttgtttgtttccttgacctcttgctcgaaatagccggtatagatgtgctcaccgcgttcaacagagccctcaagcggctggatttcgccaagcaaacttttcagcaacgtcgtttttccgatcccgtttgcgccgtaaagggcgattttttggccgcgttccatgcggaggttgagcggacgggacagcggggaatcgtaaccgatcacgagatctttcgtttcaaaaatcagcttgcctgacgttctcgccggcttaaagtggaattccggctttggcttttctgccgcaagctcgatcatatccatcttatcgagtttcttttggcgggacatcgccatgtttctcgtgctgacacgcgctttgttgcgggcaacgaaatccttcagctccgcgacttcctgctgctgctttttgtaggccgcttcaagctgctgttttttcacttcgtagacttccataaactgatggtagtcgccgacatagcgtgtcagctcttgattttcaacgtgataaatcaggttgatgacgctgtttaagaacggaatatcgtgggaaatcaggatgaacgcgttctcgtattcctgcaggtagcgcttcagccattcaatatgctgttcatcaagatagttggtcggctcatcgagaagcagaatttccggcttttcaaggagaagcttagcgagaaggacctttgtgcgctgtccgccgctcaaatcggtgacatcgcgctctaatccgatatcgctcaaaccgagaccgcgggcgatttcttccaccttggaatcaatgacataaaaatcattgtttgtcagcgcgtcttgaatgacgccgacttcttcaagcagcttttcgagctcgtcgggatcagcctcgcccattttgttgtaaatctcgttcatttcctcttccatcgcaaataaataatggaatgcatctttcaggacgtcgcgaatagattttcctttttccagcacggtatgctgatcaaggtatccgacacggacattttttgaccattcgacttttccctcatcaggttcaagctttccggtaataatattcatgaaggttgattttccttcaccgtttgcgccgatcaagccgacgtgctcgccttttaacaggcggaaggaaacgttattaaaaatggcccggtccccgaagccgtggcttaaatcctttacagataaaatactcatgtttacacctctatcgttatcaaacacgcacaatcggcgtgtaatattcacccttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggaatgcttccggctttcaaacgccaacccctgttcaagagcaggcagcccagctgatcatggacggaaaggatgtcatcgcggaatcgccgacaggcacaggcaagacgctggcgtatgcgctgccggtcttggagcggatcaaaccagagcaaaagcatccgcaggcggtgattttagcgccttcccgtgagctggtcatgcagatttttcaggtgattcaggattggaaagcgggctcagagctgcgcgcggcttccttaatcggcggggcgaatgtgaagaagcaggtcgaaaagctgaagaaacatccgcatatcatcgtcggcacgccaggcagggtatttgaactgattaaagcgaagaaactcaaaatgcatgaagtgaaaacgattgtacttgatgaagcggatcagcttatcctgccggagcatcgcgagacgatcaaacaaattattaaaacgacattaagagaccgccagcttctatgtttttccgcgacactcaaaaaggaaacagaggatgtgctccgcgaattggcgcaagagcctgaggtgttgaaggtacagcgaagcagggcggaggcagggaaagtgaaacatcaatacctgatttgcgaccagcgcgacaaagtgaagctgctgcaaaagctgtcaaggcttgaaggcatgcaggcactcgtatttgtgagagacatcggcaacctgagtgtatatgcggaaaagctggcatatcaccacgttgaactcggcgttttgcacagtgaagcgaaaaaaatggagcgggcaaaaatcatttccgcattcgaagacggagagtttcctcttttattggcgactgacattgccgcacgcggtttagacattgaaaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgaactgagtgaagctgtgtatgcaggcggaaaactgaagacgaaataaaaaggagggcggaaagcccttcttttttgttgtaaaataatagaaaaagtttcgcgcagggggtgcgaaggtggtttcaatagacaggtttcaagcagtgaaggagtcagagctgaaaattcttgaacactggtttgagaatgaggataccagacggagaatggatgggatgctgccattagatgaatggtatgcacgagtaaataaagataaacacaatactgtcatcatggcgtatgatggacagctgccggcagggatggtcgttattgagttcggagaggagcggacgtatattggattgatcgtcaatcctttgtaccggcttcaagggtacggaaaagggatattgcaaaagctgatgactgaacctgattttactagagtgcgggaatgggtggcatgcattgaagaagacaatcgaatcagtttggcttgctttcaagcagcaggattcactttggaagatacggaacctgatgaagatggttttcttacgctgattcttcgcagctgacctcatctaaacacataaggagggcaaaaagccctcccgatttcatcttcagctcggatcgctgaccttgatcagctgtttccctttattttctcccttaaataaaccgagaaacgcgtcaggaatgttttcgaagccttctgtgatggtttcctcgtaatggagtttaccagccttcagccattgggccagctgttttgctccctcagaaaaacgatcggagtagtcgctaacgataaacccttgcatcagcgactttgttttaatgagttttgattgaacacgagggcccatgtcatctgcttcgctttctgcgttataggaagaaatggcgccgcacaccggaatgcgggcaaattcattgagcaggttcatcaccgcgtctgaaatcggtccgccgacattgtcaaaatacacatcgacaccgtcaggacaagcgtcttgaagcgctttttggatatcacccgctgttttgtaattgatggcttcgtcaaactgcagctcctgttttaagtagtcgattttttcatcagagcccgcgataccgacaactcgagcgcctttgattttggcaatttgcccgactgttgaaccaacggctcccgcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcgctcacagcggaaaattcctgccagctgagatttccgatgacgatatcgccttttttcagattgttcccgtctgacacaacttcagcgataaccccgccagaaagcgcttcatctaaagcgaacggctcaacatatgacttcgtatcctgcatacggccgcgcatataagggtcaaccgatacataaagcgttttgacaagcacttccccttgcttgggttcaggaaccggaatggtttcaaagcgaaagtcttcatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggagagggggctcctctccttttcatttcgcccgtaatttcgggcacagtcccgtcggcaggcacattggcttctggtcgatcgggcttctcatgatgcagcattccaagccgaagacttcacggaaaaatggctgggtgaacacatcttccggtgttccggcattgtagatttttccgtccagcacactgatcagatagtcagcatattgagcggcttggtttaaatcatggagcaccatgacaacggtgcggccatggtcgcggttcagctttttcagcagttcaagcacttcaatctggtgtgagatgtctaaatacgtggtcggctcatcaagcaaaagcaaatcagtgccttgcgcaagtgccatggaaatccaggctctttgtctttggccgcctgagagggcatcaagtgtccgatccttcagttcaatcatgcccgttgcttccagtgcccactctaccatgtcatgatcctcttgggtatgcttggataacagctttttgtgaggatgtctgccaaaatagcataattcctctaccgtcaatccttcaggagcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaaatcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgccgatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaatcaaaagccatggcgcaagcagcttgacttcctcccagtttcttccccagaggcttcctgtcagccaaatgagtgcagcattcacgtcgcctggaaacttgaccatcatatattgcattccggcgtggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgctgcaagtccggagccttttgaaatgccgacaacgtccggggaagcgagcggatttcggatcacaccctgtaaaatcgctccggcagcggcaagcccagccccggccaaaatcgctaatatgatgcggggcagacgatattgctgggtgataaattcaaaggaatgatccaatcccagcagattcgtcactaccgcatcaggtgaaatgtataatgcaccgattccaatgctgatgacggacagaacgatcaaaatcacggccaatatgagtatcgccagcaaggggcgtttttgttttctggttgttttcttcatttcagatgccgccctttccttgccaaatataagaaaaacggcgttccgataatcgcggtgacaatgccgaccggtgattcataaggaaatgcaatccatctggccagaacatctgcgtacaccagcaaaatggcaccgaacagtgccgaaaacggaagcacgtattgataatgttctccgatcagcttgcggacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatatgagggcaagcccgatgccaatgacagaaaacggagcgatggttatgacgtcctgccagttgctgccgtcgattgcgcctgtcatccagtacagaacatcctcacctgactcatttaaaataatgatggcctgtgtcatagaggagaggaacaagtgcacggccattcctgacagcgccagcttgacaggtgtcattccgccggatgaggcaatcatatacacaatcgcgccgcctgctgccgcacccgcaaaagcgaatataacagatgaatagggcgatgccggcagaatgacgagagaagcaacgacaaaaagcgatgcacccgcattcacaccgaaaatttggggtgaagccagagggtttctggtcatagcctgcatcagcgcccctgctacagctaggctggcgccgacaaaaacgccgattaatgtgcggggaaggcgaagagtagagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgaatgatacaacagtctcacttccttactgcgtctggttgcaaaaacgaagaagcaaggatttcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcgtctacaatggttttaccttcgttggctgagatgaacaaaatatcaggatcgattttgctcaattgctcgaggctgacctcttgataggcgttatctgacttcacagcgtgtgtaaagcctagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcgatcgtttcgtcatatgtcgcttcacggctttttaattcaatcgtcggggcgatttttttcagctgtttataaatgtttttatggcgctcagcgtcagcgatgattaaatcaggcttcaaggaactgatgacctcaagattgggttcgctgcgtgtgcctacagatgtgtaatcaatggagctgccgacaagctttttaatcatatcttttttgttgtcatcggcgatgcccaccggcgtaatgccgagattgtgaacggcatccaagaatgaaagctcaagcacaaccacccgcttaggtgtgccgcttactgtcgtttttccttcttcgtcatggatcactctggaatccttagacttgctttcgccgcttccgttgttattctggcttgatgaacagccggatacaatgaggcaggcgagcaataaaacactcatgatggcaatcaacttgttagaataggtgcgcatgtcattcttccttttttcagatttagtaatgagaatcattatcacatgtaacactataatagcatggcttatcatgtcaatatttttttagtaaagaaagctgcgttttttactgctttctcatgaaagcatcatcagacacaaataagtggtatgcagcgttaccgtgtcttcgagacaaaaacgcatgggcgttggctttagaggtttcgaacatatcagcagtgacataaggaaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaaatattgcattagacatacctcctgctcgtacggataaaggcagcatttcatggtcgtgtgctccgtgcagcggcttctctttaattttgacttttctgaaaatggtcccgttcctatcactttaccatggacggaaaataaatagctactaccattcttcctgtttttctattcaatgttctggaatctgtttcaggtacagacgatcgggtatggaagaaatatagaaaacatgaaggaggaatatcgacatgaaaccagttgtaaaagagtatacaaatgacgaacagctcatgaaggatgtagaggaattacagaaaatgggtgttgcgaaagaggatgtatacgtcttagctcacgacgatgacagaacggaacgcctggcagacaacacgaatgccaatacgatcggagccaaagaaacaggtttcaagcacgcggtgggaaatatcttcaataaaaaaggagacgagctccgcaataaaattcacgaaatcggtttttctgaagatgaagccgctcaatttgaaaaacgcttagatgaaggaaaagtgcttctctttgtgacagataacgaaaaagtgaaagcttgggcataaagcaaagaaaaaaccaaaaggccaatgtcggccttttggtttttttgcggtctttgcggtggtattttgcagaatgccgcaataggatagcggaacattttcggttctgaatgtccctcaatttgctattatatttttgtgataaattggaataaaatctcgcaaaatagaaaatgggggtacatagtggatgaaaaaagtgatgttagctacggctctgtttttaggattgacgccagctggcgcgaacgcagctgatttaggccaccagacgttgggatccaatgatggatggggcgcgtactcgactggcacgacaggcggatcaaaagcatcgtcctcaaatgtgtataccgtcagcaacagaaaccagcttgtctcggcattagggaaggaaacgaatacaacgccaaaaatcatttatatcaagggaacgattgacatgaacgtggatgacaatctgaagccgcttggtctaaatgactataaagatccggagtatgatttggacaaatatttgaaagcctatgatcctagcacatggggcaaaaaagagccgtcgggaacacaagaagaagcgagagcacgctctcagaaaaaccaaaaagcacgggtcatggtggatattcctgcaaacacgacgatcgtcggttcagggactaacgctaaagtcgtgggcggaaacttccaaatcaagagtgataacgtcattattcgcaacattgaattccaggatgcctatgactattttccgcaatgggatccgactgacggaagctcagggaactggaactcacaatacgacaacatcacgataaacggcggcacacacatctggattgatcactgtacatttaatgacggttcgcgtccggacagcacatcaccgaaatattatggaagaaaatatcagcaccatgacggccaaacggatgcttccaacggtgctaactatatcacgatgtcctacaactattatcacgatcatgataaaagctccattttcggatcaagtgacagcaaaacctccgatgacggcaaattaaaaattacgctgcatcataaccgctacaaaaatattgtccagcgcgcgccgagagtccgcttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacgggctgagctcttctgttggctggacgccgtctctgcatggatcgattgatgcttctgctaatgtgaaatcaaatgttataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtagcgacaattatcggctttatctccaagcccttgccaatgggtgcaattgcaatttttgcattggcggttactgcactaactggaacactatccattgaggatacattaagcggattcgggaataagaccatttggcttatcgttatcgcattctttatttcccggggatttatcaaaaccgggctcggtgcgagaatttcgtatgtattcgttcagaaattcgggaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtaccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcagagctttccatggttatcgtgtttcttttggtgctcgtgctgtggatttttggcggcagcttcaacatcgacgcaaccacaaccgcattgatcggtttgtccgttctcttattatcacaagttctgacttgggatgatattaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacattagtgcgatgtattcagcatttttggctgtcgtcgtggcagcgggcgcaccgccgcttttagcagcgctgagcctcgcgttcatcagtaacctgttcgggtcaacgactcactacggttctggagcggctccggtcttcttcggagcaggctacatcccgcaaggcaaatggtggtccatcggatttatcctgtcgattgttcatatcatcgtatggcttgtgatcggcggattatggtggaaagtactaggaatatggtagaaagaaaaaggcagacgcggtctgcctttttttattttcactccttcgtaagaaaatggattttgaaaaatgagaaaattgcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacagcgagaaccatttcctatatgccgccggttaaagagctcattgagagaaaaggcggacatgcggctcagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggcggttcgcatgtttctgaaacaaaagcggatggacgaagagtgatcagagggagcgcgccgattataaaagaacaaaagggatacagccaagtgatcggcagcgtgtctgttgattttctgcaaacggagacagagcaaagcatcaaaaagcatttgagaaatttgagtgtgattgctgtgcttgtactgctgctcggatttattggcgccgccgtgctggcgaaaagcatcagaaaggatacgctcgggcttgagccgcatgagatcgcggctctatatcgtgagagaaacgcaatgcttttcgcgattcgagaagggattattgccaccaatcgtgaaggcgtcgtcaccatgatgaacgtatcggcggccgagatgctgaagctgcccgagcctgtgatccatcttcctatagatgatgtcatgccgggagcagggctgatgtctgtgcttgaacaaggagaaatgctgccgaaccaggaggtaagcgtcaacgatcaagtgtttattatcaatacgaaagtgatgaatcaaggagggcaggcgtatgggattgtcgtcagcttcagggagaaaacagagctgaagaaactgatcgacacattgacagaggttcgcaaatattctgaggatctcagggcgcagactcatgaattttcaaataagctttatgcgattttagggctgcttgaacttggggagtatgatgaagccattgatctgattaaagaggaatatgcgatgcaaaatgaacagcatgatcttttattccataacattcattcgcagcaggtgcaggccattttgttagggaaaataagcaaggcatcggaaaagaaggtcaagctggtgattgatgagaacagctcactcgcgcctcttcctgcgcatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagataagatggaagaagtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccaaaggagaaacaaagggggaatccatttgattcacatcgcgattgcggaggatgattttcgagttgcgcaaatccatgagagattgatcaaacagcttgatggattcaagattatcggcaaggcggctaacgcaaaagagacattggcgcttttgaagggacacaaggctgatttgcttctgctggatatttatatgccggacgagcttgggaccgcgttgattcctgaaatacgaagccgatttcctgaagtggacattatgattatcacagcggcaacagaaacccggcatttgcaggaagcgctaagggcaggaattgcccactatttgatcaaacccgtaacggctgacaagttcaggcaggtgctgcttcagtataaagaaaaaaggaagctgctcatgtctcagccggaggtcagccaagccatgatcgaccatatttttgggaacagtgtgaagacagctttgccggcagaggatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtaccttgtgtcaaaggaagaagcaagagccgagcttgaatacgggattatcggcaggccggagagaaaatattatttggcggcggattagatatgaaaaaatctataatcctattgattattctattgatctttatgcagggtgatatcaggcaggcggctgcgccgcgcctgccggacgggccgatagaaattgtcgtccctgccgaaccttctggcggctgggatgtcacagcgcaggcgatccaatctgttttgaggcagaagcagatcgtgaagggtgatgttcatatcgtctataaatccggcggcggggagagaaaggctggaaatatgtcaacaaaagcagcaaacaaaccatcagcatgacgtccagcctaatattgagcaatgatcttctcgggcaaagcaaattaaaaatggccgattttactccgctcgccattctctccaaggaatggcagacggttgcattgccaaaaggatcagcgttaacaaatggcaaggatgtgctgaatgagatcaacatgcatcccggcaaggtgagaatcggctttgccccgggtttggcaatgatgatcagctctcgttcgtcagagcggcagatatgtacggcattgacccgtttgacattcaattctcacagtatgacagcagtgaacagctcattcaggcgctgatcagacatgagatagaagcagcttccatgaccctttctgaagcgaaaccatatgaacgaaacggcgatatcacgttagccgctgtaacgtctgataaaagacttcccggttttccaaatgtaccgacgtggaaggagcagggaatcccgtttgttttttctcattggagagggattttgggcccgaaaaatatgtctgaggaagagatttcttactgggatcaagcgctaaagaaggtcacctcttcacctgaatggaagcggaaaataaacgaacaggactgggaaagcttttatttaaacagcagggaaacgaaacggtttttagaagagcaatctgctttttatcaaagcatcatgacaggaaattaagatcccggcatcccggattttttcatgccgaaaattgatcaaaaagaacaaaacggttttaaaaaattaaaaatacaaaaaaaccaaattatttacttgcggttggttttcccatacgatggcaaaaaggcaagacaaaaaggggagtaagggagaaaaaaatgtaagcggattcatttaagggggaatggatgtgttagcaatcttaggctttctcatgatgcttgtgtttatggcattgatcatgacaaaacggctttctgttttaacagcattggttttgacgccgattgtgtttgcgcttatcgccggatttggatttactgaagttggggacatgatgatttccgggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggttcttacaatgctcgtcgccttggacggagatggctcgacaacgtacatgattacgacaagcgccatgcttccgctctatttgctgctaggcatccggccaattatcctggcgggaatcgcgggagtcggcatgggaatcatgaacacgattccatggggcggtgcgacgccgagggcggcgagtgcgctgggggttgatccagctgagcttacaggtccgatgattcctgttattgcaagcgggatgctttgtatggtggcggttgcgtatgtgcttggaaaagcggaacgaaagcgccttggtgtgattgaactgaaacagccagccaatgccaatgaaccggcggctgcggttgaagatgagtggaagcggccgaaactttggtggttcaatttattgttaacgctttctttaataggatgtttagtatcgggtaaagtcagtttaaccgtactgtttgtcattgcgttttgtattgcgctgattgtgaattatcccaatctcgagcatcagagacagcgcatcgcggcgcattccagcaacgtgctggctatcggttcaatgatttttgccgcgggggtgttcacggggattttgacaggcacgaaaatggttgatgaaatggcgatctcgctcgtgtccatgataccggaacaaatgggcggattgatcccggcgatcgttgctttaacaagcggcattttcacattcttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatacaacattccggaggtgtcattatgagtgatccttatatgccgctgacttcagtcagaagcggaacggggttcgaagcggcaaaaggggtgcacggcctgactgtgcaaattgcgaatgtctattttattcagctgccttctgaacctcactcatttgttttaattgatgccggcatgcctcaatcagccggcatgattgtcaatgaagccaaacaaagattcggtgaagggtttcagctgaaggcgattatcctcacacacgggcactttgaccatattggggcaatcgaagagatccttgagcattgggatgtgcctgtttatgtccattctcgggaaatgccttatgtaacaggtaaagaggattatcctccggctcgtcctgacagcaagagcgggctggtcgccaagctgtcgccgctgtttccgcggcactccatcgatatttcctcacatgtccaggcactgccggaagacggttcagttccttttcttgacgagtggatgtggatcgcgacaccaggacacacgccgggccatatttcgttattccgcgatgacggccgcgtgcttgtagcaggtgatgctgttattacagtggaacaggagaaaatggctgacgtcttgatacaaaaacaggagcttcacggtccgccggcttatttcacgcctgacacagagacggccgcggagtccattctgaagctggccggtcttgaaccggaagcgttattgacagggcacggcataccgatgaccggcaaaaactttcgaagtgacttaactgaattggcaaatcggttatcgtctatttgacacccgcaccacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagtgaaattgacctgaccggaagctatgtacatacgaaggaagagctggagcacggagcgaaaatggcttggagaaacagcaatcgctgcatcggcagattgttctggaattcgctgaatgttatcgacagacgagacgtccggacgaaggaggaagtgcgtgacgccctctttcaccatattgaaaccgccaccaataacggaaaaatcagaccgaccattacgattttccctccggaagagaagggtgaaaagcaagtcgagatctggaatcatcagctgatccggtatgctggatatgagtcagacggagaaagaatcggcgacccggcttcctgttccctgacagcagcttgcgaagagttcggctggcgcggagagcgaacggattttgacctgctgccgctcatttttcgcatgaaaggcgacgagcagcctgtctggtatgagctgccgcgttcacttgtgatcgaggttccaatcacacatccggacatcgagacgttttctgatttggagctgaagtggtacggcgtgcctattatttctgatatgaagcttgaggtcgggggcattcattataatgccgcgccatttaacggctggtatatgggcacggagatcggagcgagaaacctcgcagatgaaaagcggtacgacaagctcaaaaaagtagcgtccgtgatcggcatcgccgctgattacaatacggatttatggaaggatcaagcgctagttgaattgaataaagctgtgctgcactcgtataaaaagcagggtgtcagcatcgttgaccatcatacagcggcaagccagtttaaacggtttgaagaacaggaggaagaagcgggcagaaagctgacgggggactggacgtggctgattccgccaatttcacccgctgccactcatatcttccaccgctcctatgataactcaatcgttaagccgaactatttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtctacaatgattcggtattgaagcatgtaaaaaccaccttttctttttatgataatcaatcattttacaacctgtaaaggggatgtgtttgtatgaaaccagagcgctattcagttctttctcttaatctgggaaaaccgcagacgcttgaatatgacggaaagaaaatcgaaaccggcatcatgaagcggccggctgaatcagccgtcatgctgtatcgggagaattttgaaggagacggacaggcggaccttgtcaaccatggcggacctgataaggctgtctgtgtctacccggcggagcattatccgttttgggaagagttcctttcaagaccgctgtcaaatgccgcatttggagaaaatctgacggtcgcgggcctgactgaggagaatgtttgcatcggggatgtgttcaggcttgatgaagctgttgttcaggtcagccagccgcgccagccgtgtgtaaagctggcgaaaaagtttggtgtaaaagaaatcgtgctgaaggtccagcaaaccggctatacagggttttattttcgcgtgctggaggagggcagggtgtctcccggcgcgaaccttgaattgctgtccagaggagagaaaggcatatccgtccagttcgccaaccgcatcaactaccatgatgcaaaaaatctcaccgccattgaacggattttaagtgaggctgcactatcggaaagctggagagcgtcctttatgaaaaaaaaggacaggctgcagccggttgaatagaaaaaagccgcgcatatcaacgtgcgcggctttgccatatttaagattgttttttctttgattcaagcaggttggcaagaaaataggttttatagctttgaagctttcttccttcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgcactagatgtacgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggtcataatgatgccttcaatgaaaaaaatgatgccgaaaataataaaccacatgcagataaaggctcctttcacagacataatagtagtgtagcatatctgaaagagccgggctgtgacaatatcaagaaagccgggcgcatatcgcccggctcatgttttattgtttatcaaccaatttgaccagaagctgtgccaaatgttctttctcaccttcgtctgcaacgctccaaagctcttgcagcagcatttcttcaccgttttgcggctcttcatgctttgcgaggtagtctcccaagatcgcagcgctttttacaagcttgccgtcatccaatcccagctttttgcctcggttgacttgttttttcaggtagcctttaaattcatcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagtgcgttatcaaacggatcataatagttcatgatgtgattcggcgcttcatgcaggcttcgtccgattccgtggccggtcagggttttgatgacggtaaagccttgagagcgtgcttcatgataaacggctcttccgatctggttttggcgcttgcccgcttttgcctgctgaagccccttttgaaaagcgttttccgcgcattggcaaagcttatgaaggcgttcttctccttcaccgagcacaaatgagatgcctgtgtcggaatagaacccgccaaattcagcggagatgtcgatgttgacaagatcccctgcttttaaaattttggatgtgcttggtatgccgtgagccacttcatcatttacgctgatgcatgtcacacctggaaaatcatattccttctcaggagctgaaacggcgccgtgctcatcaagcacagcttttccgataaggtcaaggtcttttgtgctcatgccgggctctgccttccgcttcatttcttcacgcgcaagcgcgacgattcttccgatttttttcaggccttctaattcttgatcgtttgttacaatcatctgtcattcccgctttctttttaaataatctagattaagcttaccacaactgtcttaaaaataggaaacacacggacctgggaaaaaagaaatacccccgggaaaattggtatagatcactagatatcttatatggtatatttgaaaaaaaagggtatgagggggatgggtatgctttcatttttacaaaaactcgggaagtcatttatgctcccgattgcagttctgcctgcggttggaattatccttgcgcttggcagagaggatgtatttaatatcccgtttgtctatcaggcggggacggcggtttttgatcatctgccgcttatttttgcgatcggaattgccatcggcatttcaaaagacagcaatggggccgcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcgggttcttcagcggcagacggcttgtgccgattataacagccattattacgatcattttagcgggcatattcggagtcgtctggccgccgattcaatcgtgtataaactcgtttggagagtggatgctcgggctcggcggcatcggggcaggcatattcggccttttcaacaggctgttaattccgcttggccttcaccatgtgctgaacaatattttctggttccaatttggagaatataacggagtgacaggggatttggcgcgctttttcgcgaaagatccgacagcgggcacatatatgacgggattcttcccaatcatgatgttcggtcttccggcggcgtgtctggctatggttgtgactgcgaagccgtctaaacggaaagcgacggctggaatgatgattgggtttgctttaacggcgtttatcacaggaattacggaaccgattgagtttgcatttatgtttttatctccgcttttatacgctgttcacgcggtcttaaccgggttatctttatttatcgtcaactggctcggcatccgttcaggcttctctttttcagccggagctatcgattatgtgctcagctatggaatcgcggaaaaaccgctgcttctgcttttggtaggtatatgctatgcagcggtatactttatcgtgttttatgtactgattaaggctttgaatttaaaaacgcctggacgggaagacgatgatgtggatgaagtgctggatgaaaatactgttcaggatgtaaatgaaaacatcatgctgaaagggctcggcggaaaagaaaaccttcaaaccattgatcattgcgccacaaggctgcgactgactgtgaaggataccgctttggtggatgaagcgctgctaaagaaagcaggcgcaaaaggggttgtcaaatcagggggcaatcggttcaagtcattattggcccgaatgtggaatttgcggcggaagaattgagagctgctgtcaaataaaaaagcggagagggcaacctctccgctttttcttatttatcttcgttatcctttgacgtttcggaagaatcttcgtcatgttttgtgtaatcataatcagaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgtttcggaacggaatcacttcacggtgttctttcgataaaatatcagaaccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatccttgccaagcactttcgccatcgctttattgtggttttcagagatgccgtagtggtctccgtacatcacaataatcgatttatcatataacccgtcttttttcagatcattgaagaattgttcaatggactgatcaaggtaatgggctgactggaagtagttatcgacgacagagtcaccaaagtctccagccgggaagtctgtatccccctcatccattccgaatgggaagtggttggaaagggtaatgaacttcgtatagaacggctgcggcaggctttccagcagcggcattgattctttgaagaacggtttgtctttcatgccgtagtttttcgtgttttcttcgttcatgtcatagtaggcagaatcaaagaatttatcaatgccttccgctttgtacatttcgttacggttccagaacgtctgcgtgttcccgtggaaagtagcagatgtgtaattcttagacttcagaatcgccggaacggattgcagcgtgttttgcgctttgtttacgaaaactgaaccttgagccagcgggtacagagagttttccatcataaattcagcatcagatgttttgccttgtcccgtttggtggaaaaagttatcaaagtagaacgtttcgttatcatgtgccagtttatttaagaacggtgtcacttctttgccgtcaattttatagtcgatgataaatgactgcaaagattcaagtgaaacgtaaatgacgttttttccttccgctttgccgaaatacacgttattcggcacatcgtaattggctttcatgtagttttctacttccgttacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccaggttgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgttggcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataaccgacatacgttttgatccataacaggacgaccgcaattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaataaaggaataaaatggtacatcgggaattgtatgataaaatataaggtatagataaaaagaggtgaaatgatggatttttcccatattgtgtctgaagataaaattaagcgcgccatcaaagacggggactttcaaaacctcccgggaatggggaagccgctgccgaaggatgacgcggcacacttgccggaatcgctgcgcatgggctatcgtattttgaaaaacgcgggaatggcagaggacgagggcgctctcaaaaaagagcttatgaccatcgaccatttaatcgaaaagtgctatgacgaaaaagaacgcgagcaattaatcaggaaaaaatctgaaaagcaattgctgcttgataagcttgtcgacaaaaaaggcatgttttcaaagccagcatccgctttttataagaataaagtatatgaccggcttgaacggaacagaccttcttccagctgatttgtcttgtctgcaggatggcgattgataaaagccatcctttttatgttccaagttctatatcaaaaggtttatgtttttccatctatgggaaatgacccataaacgaaaaaagggtgatgggatggaacgtctattagtatggatagagcatatatctgattggctgtgggggccgccgctaatcatcctgctgacggggacggggttgtatttcactattttgctgaaaggttttcaatttcgctatcctttatacattttcaaacagactatcggcagcgtaggaaaaaagccgaagggagagggcacagtcacaccgcttcaggcattgacctcagccctcagttcaacgatcggtgcagcgaacattgtcggtgtgcccgccgctattatgtttggaggaccaggagcggttttttggatgtggcttattgccttatttgccatggcgattaagttttctgaaagtgttcttgctgttcattacagagaaaaaaatgagcagggtgaatacgtcgggggaccgatgtattacataacaaaagggctgcgcatgaaatggctcggcgtattcttctctgttgcgctgattgtggagctgattcccagcattatggttcagggaaattcggtttcagtctcgcttgccgagacgttttctttcaataaaatatacgcaggaatcggaattgcatttttgattgggttagtggtgataggaggggtaaagcggatcggaaaagtaacagagtttgtcgtgcctcttatggcaggggcatacgcaggtgccggtctcctgattgttctcatgaatctatcatcagtgccggcgtttttctctctcgtcttttcaaatgcgtttacctcttcttcagcagttggagggttcgcaggtgctgcgttggcggaaaccgttcgctggggatttgcccgcgggctttattctaatgaagccggaatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgacccggcagcactgacgacggctgcatttcagcattatttcggttctggcggagggtacttcgtttcggtttccctagtcttctttgtcgtatcaaccattatggttgtcattttttacggtgtaaagcaagctgaatttctgttcgggcggctggcaggacacgtgattaaattcgtttatttagcggctattatcataggtgccgcaggcggagcaaaagccatttggggctttttggacttagcattggcttttattctcgttccaaatgtgattgcgctgttgttattgagcagaaaggtaaaagcgctgtacaccgaattctttacatctgaacagtactacctgaaagatataagaaaaacaaaacagaatcctgtttatcaaacaaaagaagctaaaaattcctagtgctttgctttggcgctgaacaacgctttgctttttatgatcaaataaatgagtaaaggcagcaaaatagaaatcacttcattaatgattggtttgattctgttaaagtcgaagctgatttgtatgtaagaagaaccaaaagctgccggttggtgtatacatggctttcgggtcgtttttagagcgataggctgtaccacgatacttcactataatgacggaaatccaaaaggccgtgatgatcaggcctgaacgatccaagatacaatcattaccatggagcagacacaatttccgcatcagtactgtcccaataacaagagcgccgaggatgctgaccgtctgaccaacggttttcggcaggcgcactccctcttcacggagagcctcagctgtatggcggggaaagaaatcggctagcgggcagacgccgcgctgaacattataccctgaggctttcagtgaagccctctctcgatcctttgatggtcgattctgttattaacttttcaaagtttcttcataaacaataaatccgcacagcccatttccaaagtcaaattgtctaaatacgatgtttgagcaaccttctgtaagctgggtcagattatcgaggttttccttcaaattgggagagatcggtctgtcctgattgtcttcaagctctttgatgagctgaagcgctttgtcgcgtttattcatagaggctcaccctgctttttaatgtcatattcaataagtgcttgtgacttttagggtaaccttgtctgtttcatataatccagactaggatgaaagcgctataaaaaagtgttgactgcctgtatatacaggaatacaatatgattataagttgtatatacaagttataaaaacggatacggaggggttggcatgggggaactgaacaaatcggcacgtcagattgtcgaagcagtcggcggtgcagaaaatattgcagcggcaactcattgtgttacacgtttgcgttttgctttaatagatgaaagcaaggttgaccaagagatgcttgatcaaattgatgtggtaaagggatcattctcgacaaacggacagtttcaggtcgtaatcggccagggaactgtcaataaagtatatgctgaactggttaaggaaacggggattggcgagtcaacaaaggatgaagtgaagaaggcctcagaaaaaaatatgaatcctttgcagcgtgctgtgaaaacgcttgcagatatttttattccaatattgcctgcgattgtcacggcgggtcttttaatggggatcaataacattttaacggcggaaggcattttcttcagtacaaaatcgattgtgcaggtttatccgcagtgggcggatcttgctaatatgattaacctgattgcaggcacggcctttacgtttttgcctgcgttaatcggatggtctgccgtcaagcggttcggcggcaatccgcttctcggcattgtgctcggagttatgctcgtgcatcctgatttgctgaatgcgtggggatatggagcggcagaacaaagcggagagatcccggtatggaatctattcggcctagaggtgcagaaagtcggctatcagggccaggtgctcccaattttgcttgcttcttatatgctggcgaagattgaggtatttttaacaaaacgcacacctgagggcatacagctgctcgttgtcgcaccaattacgcttctcttaacaggatttgcctcttttatcattatcggcccgattacatttgcgatcggtaatgtactgacttcagggcttatctcggtgttcggttcttttgccgcactgggcggtctgttatatggcggtttctactcagcgctcgtgattaccggtatgcatcacacgtttcttgcagtcgacctgcagctcatcggatcaaagctcggcggcacctttttatggccgatgctggcgctttctaatatcgcacaaggttcggcggctctggccatgatgtttatcgtgaaggatgagaaacaaaaaggcctctccctcacatcagggatttctgcttatcttggcattacagagcctgccatctttggggtgaatctgcgatacagattcccgtttatcattgcaatggtcagctctggcctggccggaatgtatatttcttctcaaggtgtgctggcaagctccgtcggtgtcggcggcgtgccggggattttctcaatcatgagccagtactggggcgcgtttgcaatcgggatggctattgtattgatcgtgccgtttgccggaacatacgcgtatgcgagattcaaacataaataacaaatggggagcgggacgtgttgaacgttcccttttcccgttttcaatttaaatatggtggtggaaacagatgaaaacagaacaaacgccatggtggaaaaaagctgtggtttatcaaatttatccgaagagctttaacgatacgacgggaaacggtgtcggcgatttgaacggcattattgaaaagctggattacttaaaaacacttcaagtggatgtgctatggctgacgccgatttatgattctcctcagcatgataatgggtacgatattcgtgattgttactcgatttatcctgaatacggaacgatggaggattttgagcggctagtgtccgaagcacataaaagagacttgaaagtcgtcatggatcttgttgtcaatcatacgtcaacagagcacaaatggtttcgcgaggcgatctcttccatagacaacccgtatcgtgatttttatatatggaaagacccgcaggaaaacggttctcttccgacgaactgggaatcgaaattcggcggctcggcatgggagcttgatgaagcgtcgggccaatactatttgcatctgtttgacgtgacacaggctgatttgaattgggaaaatgaagaggtcagaaagcatgtctatgacatgatgcatttttggtttgaaaagggaatagacggcttcaggcttgatgtcatcaacctgatttctaaagatcagcgctttccgaatgcggaggatggcggcgacggccgctctttttacactgatgggccgcgggtgcacgaatttctgcatgaaatgaacgaaaaggtgttttcgcattacgacagcatgacggtcggtgagatgtcttcaacaaccgtagaccactgcatccggtatacgaatcctgacaataaagaacttgatatgacattcagcttccatcatctcaaggttgactatcccaacggcgaaaaatgggccttggcgccgtttgactttttgaagctgaaggagatcctatccgactggcaaacggggatgcacgcaggagggggatggaacgctctgttctggtgcaatcatgatcagccgcgcgttgtatcaagatatggagatgatggcgcatatagggtgaaatcggcgaaaatgcttgctacggccattcatatgatgcagggcacgccttatatttatcagggcgaggagctgggaatgacgaatccgaagttttcggacatcagctcctatcgggatgtcgaatcgctgaacatgtatcacgcctttaaggaaaaaggaatggcagatcaagagatcacagccattttacaggcgaaatcccgcgacaattccagaacgcctgtccaatgggatgatacgccgaatggcggttttacaacgggcaccccatggataccggtcgccggcaactatcgggaaatcaatgccgaagcggcgctgagggatcaaaattcggtgttttaccattatcaaaaattgattcagattcgcaaaatgtatgacattgtgacagagggaacgtatgagataatcgcaaagaatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaaccgtgaaaaaatgcagtttcccgtttcgggccttgtcagcttcaaggagctcgcgcaaacgcttggcaaagaaacgaaaacaactgtacacaaattcgggctggcgcctccgtcagagctgatccaaaaacagctccgggccaatctggatgacgacatctgggaagtcatcaggtctagaaagattgacggggaacatgtgattttggacaaggattactttttcagaaagcatgtccctcacctgacgaaagaaatttgtgaaaactccatatatgagtatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagtgcgcttttttgtttggtatcaaaattgatactatccaacaaaaatgtgcgtacttttactttttatcataatggctacaatagagatgagagtaacctaaaggagaggtgttttacatggcagatctaaagaaacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggaattccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgcctcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatcgaaggcttccagtacgatcacatccaccgtattcttgaagaagaaggccttctggaaaacggaagctttgatatttctgtgatggtggcattcggctatcgagtgagagaccctcgcccgaaaacaagatctgctgttgaagatgttgtgaagtgggtttaaataaagaaagctgctcgctaagcgagcagctctttttttatgcctgattcgctctattctgttttctcctctgatgtaagtacattgccgttccgagtgcactaatcagaaatccggccaacaggatcgagtacatggatgtggctgtgtccggaagcaggccgccagccggaccgtctgttcctgatccgcccgaaccgtttccaccagagccgttagtcagttgagtgccgggaggcgtatcatttcctccgtttccgtcagttggctgttttccgcctggtttgtcggagcctccgccatgattgccgtcatcaccgcctgtcggttggtcggacgggaatgccggcggtttgttgtttgaaccggaatttaagatcgtgtattcgctgaagtggtttgtatatcctgtcaccatatcatcatcgactgatccgtgacctgtctttgtgaaagctttcttttttctatcgacgtgataaatggcagggttatgggcttcttcaatatcaaacatgcgaagcgaaagctgtacgggctccttgaatgattttatttcttttcctttttgcttcactgtaaagtcatatacatctgacagtgacacatccaattctcccgtagacttgattccgattgcagtgtctgcggttttaaggttcgccattggcatcttcatgctgtaccagtagttgaacatcgtcaatgaaggatctgactctctttctttcaaaagtttgacctgatcttttttcactttaagattgataggcttctcttgagatccttcatgtattccataatagacaaatggcgtgttggcatttttagcataaatcgcaaatttgtcttcatcaagtgtccagctgccgtccttctgctttgtcggcaggaatacttctttgatccgtccttcaactttaggagagaccttgtttcctagttttttcagctgttcggtgaaaatctcataatcaacgtagccaaggtcttcaccatgggaggcttctgtaaagacagaatatccgtctcctccggcaccgacaaaattatttgttgccacgcggtaggtatcatccgtatttatagcaactttgtctccgttaggcgattcaattttcacttctaatacacggtgtccaggttcgttgtttaatgtaaaggtatattcgattccggccacctgagggaaagcgccgccgccattttccacattgcttaggccttgttcaagggcttctttaatttgttttccggttaaatcggccacgtaaagcgtattgccgaacggcatcacgttgagcacctcgccgagtgtgatatcacctttgtcaatgcctgctctgatgccgccgccatttgttatcgctattctggcgccggctgcttctttcgcttttgccagcataccgtccgcgatgaagtttccgagattcgtttctttcgtgcgcacatgctcacgctggccgtcaagcgccacatccgtatagccgactttttcatttttcacgtcttctaattcacttttgaactgatcaagctcttgttttgcttctgcgttttcttctgtatgctcatcaattggcagcacgctcagatttgatttgtctgtttgcacaacgccattttcatcaaacgcgacatcaacgcgccccaagaattggccgtattcttttgcctgcgccacgatcgtcggttcttcgttgtttacgacctccattttgtcaacgagggtgtgagtgtgtccgccgatgatcaagtcaatgccttttacttttttggctagctcaagatcacggttatgaccgatatgtgttaaagcaataattttatttaccttttcttcttcctgaatcgctttgacggtgttttgtgctgtttcaaaggcatcattgaatacgatgcttttgcccgggcttgatgtggtggctgtatcttctgttgtcaggccgaatacggcgactttctccccgtcaacgtctaacagaatgtaagggtgaatgccggcctctttcttttcacctgccgtaaaggtttgcggctttttgacaaatgatttcagcttgggctcatttgacacatctacgtttgcactgacaatcggaaattccggcgcttcaaagtgatagcggttcgccggatcaacggttgcgctgtttccgcttagaaaatcagaaagcactgtcgggcctttgtcaaattcatgatttccgaaggtcatggcgtcatagcccatcatgttcatcattttcagatcggccaaaccgttccattttgtaaaatacagatcgccggaaaacacatctcccgcatcaaggagaatgttgtgatttgtttcgctgcgtacttcgttgattttcgtcattcgtcttgctgcatcatcgagatgtgcgtgcgtatcattggtgtgcatgacggtcaggtcccacagtccgtctttaggaggatctggatttgaatcatcatcgaattgcagcttatacacaccatagccttcattcgcagacttgcctacataagcgacgtcgtctgctttatcggcaaatggcttggccaaaagcgaggattcaaacgtcagattcgtgccggaaacaggcgcgattgaccagttgttgtctgcttttggattgactgttttttgttcaataatgtaatccatcagcacctgcctattttcaactgcagagccgtggacaattttatcgctcgtcagatgagggaacccgccgcctccggacgcacgatagttattggtgactacgagaaattcctggcttgggctgatcggcttgccttcataggaaagattgatgatacgggatgaatccgcattgatcacttttccgttctcattgtatttagccggttttgtcacatcgacctgatatgtgacaccgtcaatcacatcaaaattataggagcggaaattctcgttcagtaaggcctgatcgccgcctttggctggatcaatttgattgaattggcctgctgacatctccagccagtccttcacttcgctgcctgtcagcttgacgatttgaacagtattatcgtaaaggtacaagtcaccgacatttttaatcgcaagatctccggctggaatgtttgtatagtaattggctccgtttctgccgcctgctttaaacggcgctccagcggataaaatcggcaggttcttgtactcggtatccttcatttctttttcagcgtaccacttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtttcgtttcttgatgtgacgttgccagcaatagattcaatacttcctttggaatctgctaccttccatgagccgtccgccttttcaagcttgaggtcaatcacgcctaaatatttgccccagctgcttggcatgacgacaggaatgccgttaattgttcccttttccacattgaactgagcaacacccgcatactcggcggaaggaaagagtccgtgctgatggcccgagataatcgcgtcaatgcctttcgttttggtggcaaggtcaaatacggcgttttctgcacctgatgattgtgactgcttttcaatgccggtgtgggcgagggcaataatgacatctgcgccttccgccttcattttcgggattgtttcattggcggattctacgatatcctgcacctgaacctgcccctcgagattctttttgtcccatgtcatgatttgcggcgggacaaagcctatgtaaccgacttttactttctgctcattaccgttttcatcaatgagggttttttcattaatcacatacggcgtataacggttttcgccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgtgccggagataatgtcgtctttttgatatttcaccgcgtattcacccagcggattcccttgaatcaagtcgccgttatccacaagcagggtgttagggttttgctcgcggtgcttttggatcaattgcgctgttctcgccagaccgaaatccgccgtttctttgtcactgtagtaatcgtaatccatcatgttggcatgaatatcagtcgtagccaaaatactcagatgcacctgaggagccgcgctttcttctgcatgaatgggtggtgttgggaggattaggctaagtatcataattgggggcaaaagaatacggagaatgttttcgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtattatgtagcagtatcaagcgacaaatactgggtatttatgcttatcgtttgtcacaatcgcggaatgtttattttagtgtggctggggtagagtgttttatgtagacatataaagcgggaggttatgaatcatggggaaaaaaattgcagtggttttaacagattattttgaggacagcgagtacactgagcctgcgaaagcctttaaagaagcgggacatgaactgactgtcatcgaaaaagaaaaaggaaaaacagtaaaaggcaagcagggaaaagcggaagtgacggttgacgcgtccattgacgacgtaaacccttcagactttgatgcgcttttgattcccggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggacgatataccggcatttaaccgcgagtcattggcattgcttgagaaataagaaaaaacggacgctcttgggcgtccgtttttttgttgcttaggcttgagcacctgtcagtttcttgtacctgtaatacaagaaagcagctgcagccgttccgatgaccgcaatgccgaagtcgaatatgaaaatatgggcgatgccccccgcttttgcgataagccctgttgcaatcggcagcagaatcgatgcaaggcttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatatgaacggtcagcatgactgcgagcgtacataaagtaataataggatataagagcgttatgaagacaggtttgacccatctattcagcaaaacggctaataataaaacagatgccagagatcctatactataatagctcagcaattgtacagatgctgattcagctaaaccggctgccttttgcgcgtagctcgggagccagatttgagaaaccgtaaataaagccgtggatgtaaaaccgatgataatcagtgcggtgccttccttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgctaaaaatgtgatcaaaagcggcaaaagtgcggccccgacagacataaaggctttgaccaagacattcgccgaaccggaagcagacggaaagagctcggttagggccggatatgttccggcatccatggctgaattagcgactccggctaataaagcgaacacaaacgccagttcatagctcggtgataaaggaataccgactaaaaagacggccataattcccgcagaagcgacaacaagcggctttctgccgattttatctgatagaactccggaaatgccgtatgtcagcagtttgccaaacccgatagcggcaatgacataactgatgccggtcggatcggtattccactgttttgttaatgaggacatattggatgcgagaataatgttgaccatccccagaaagaagtagttgatatacattccggatgctgttttgatagatgtcgtttgcatgcttgtactccttcagatcttattcgaacactttactgttttggtttgaggaaatgataaaaaagactcgccgagtttccggccagtctccattatttacgaagcgaggctaattcttgagcaattgcctgcatttcacttgggctgaatgattcttttttcatcaccatgctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaattccatcagaaaaaaaccctattctaaaagcaggcttttaattccaaaaaagtgaagacatcagttgaaaaggaaatgaacatcctactaagatattcatgaaggtttctttttagagaaataggggcaaagaatagggaggttgcacatcatgataagcgtgttatttgtttgtttaggtaacatttgccggtctccgatggcggaagcgatttttcgggacctggcagccaaaaaaggattagaggggaaaatcaaggcggactcagccggtattggcggctggcacatcggcaaccccccgcatgagggaacgcaggagatattgcgcagagaaggaatcagctttgatggcatgctggcgcgtcaagtcagcgaacaggatctggacgattttgattacatcattgcgatggacgcagaaaatatcgggagcctcagaagcatggcgggttttaaaaacacctcgcatatcaaaaggctcttggactatgttgaagattcagatctggctgacgtacccgatccttactacacagggaactttgaagaggtctgccaattaatcaaaacgggctgtgagcagttgcttgcatccattcaaaaagaaaaacaattgtgagtgaaaggagaatttgcatgaacaacgaacgtttaatgctgaaagggatatttctcggagctgcggcaggcgcggcgttatcactgctccataagccgacaagacaggcgtgcgggatgagatggctgacatgcaagcataaactttcactgtacaaaagcaacccagagctgttaaaaaacactgtcatcacaaaagtggatgaggccaaaaagctcgcccgaacgctttcaaaggaagtcgactttgtgaaccagcaggtgaaagagctgaagaaaacaacgccgcaagtgatggaactcgtgcaagaaacgaaagagcatttttcaaaaaaatgatcaaacatgcgaggtgagacgacatgagttttttgaaagagcttttcagcagatacacccttcatgaaggacaaagtaaatcagcggagctggcgtatttttttctattgtcactgtttccgtttttgatttttatgctgacgctcaccgcgtatcttccgctttctaccgatgatgttttaggagtcatagaacaatatgctcccgccagtgcgatgtcactcgttgaatccattacccatcaaaccttaaataatcgaaatggcggtttgctgtcattcgggattatcgccgcattatggtctgcgtctaatggaatgaacgcgatcgtccggtcgctgaaccacgcgtatgatgtggaagaaaaccgctcttttatcattgttcgtctaacctctatttttttgacgattgccatggtatttacgattttagtggctttgcttctgccggtatttggcagggagattggaaggctcgcttctgactttgtcggcgcatcggatctgtttttatccgtctgggccgccattcgctggggtgtcagcccgcttgtgcttttgattgttttttccgcgctgtatgtgattgcgccgaacaaaaagctgtctctccggtttgtcatgccgggtgcggtctttgcgaccatcggctggattattgtcagcacactgttttcgttttacgtcagcacgtttgcgaactatagcgccacttacgggagcatcgggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcgggggatatcgtgatgaccaagcatacgaaaaaaggcggaagccataacaaacaaaattcgaaaagcaaatcgagcaataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccgggccgaggatgctgccgagactgaatgtaatgccgcaaagcaggtttcccgccggcaggaggtgaggcgggagaagatctgtcatatagctgatgccaagtgtaaaggttgatccgactgccattcctgcaataaaaaagcagccgccgatcacgtaaggcgaaggaaatacaccggcgatgaaaaagcaaagagccccagtcagcaaaatcaccagcagcacattccgcctgccgtatctatcgctgaggatgccgagcggaaactgaaaaataatgcttccaatcgcaaatgcgggaaggatgatcgctactgcgtctactgatatccccaaacggagcgcgtacaccggaaagcttccgttcagcgccgtttccaaaaagccatagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaacgggcctgcggcaaagccaaggccaaaggaaagcccgtaaatagacaggtttcttccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggtgcttccataaacggcgaagccaaaagcacaccgatatacagcccggtcgcgtgcaggccgttgatagcagcggattctccatttgtttcaaaaatgattgaaatgacaggcagcagcatgccttgtgaaaacccggaaatggaaacgagcaagacaaggataaagaaatgaaatcgtgacatcgtgtcagttctccttatgtggaatctatgttgatcgtacaatgttttccaaaagcaggcaacctgaaaaaagcctatatcacgctatacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgccgtttattgcgtgacgattatcgcgcttgcaagctatatggggagggcgacagaatcactgtccattattgcaggaccgcgtatcggcggtttgttgaatgccaccttcgggaatgcggtggagctgattatttccctttttgcattaaaagaaggcctgacaggaatcgtgcttgcctctttaaccggttcagtgctggggaacctgctgctggtagcgggcctatcgttttttgtcggcggtttaaaatataagcggcaggaatttaatatccatgatgcccgccataattccgggcttctgatttttgccatcattgtcgcctttgtgattccggaggtattctctgttggtatgggaaacgccagcaagctcaatttaagcatcggcatcagcatcattatgattctgttatatgtcgcggcgctgtactttaaacttgtcacgcatcggggcgtttatcagccgaataatgcggctcagactgaagaagaggaagagccggaatggtcagggaaggttgcgacgattgtcttgtttgcggcaacgattgtggttgcatacatatccgaaaacctggtccatacctttcactcggtggctgaacagttcggctggagcgagctgtttatcggggtcatcatcgtggcgattgtaggaaatgcggcggagcacgcgtcagcgattattatggccttcaaaaataaaatggacattgcggttgaaattgcagtcggctctacgctgcagatcgctatgtttgttgcaccggttctcgtcatctgttctatcttttttccgacaagcatgccgcttgtatttacattgccggagctcgtcgcgatggtatcagcggttctcttgatgatcgcgatttcgaatgacggggattccaactggtttgaaggggcgacactgcttgctgcatatgtcattatggcgatcggctttttccttctttaacctgaaaaaatgatggataacaacaaagcgggatgaaaagactaagggaaaatgccatagaaagagtgatatgatgaaaaagctatttcattccacacttattgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtaaagattgaaaatccgcatctcatcaaaatgctgaatgaatccaacatatccggcacaccgcttgcagtagggtaccgggcgacaatatttctcgggaaatgggcgctcggctatgaatcaaatgaaacagtcgcaaactgggaatataaaaaaatcaatacaaaccgtgcggataaccgcggcgggaaagaaactgctgaaatgcattatgcccaggaacagcagtacagagtgaagggcggcttgacagctaaagttccaaatgctgaagatgtcaaaagcatgatgatgcaaaaagcaatgaagaaaacgaaccttccgcttgcatttgagacggtcatcggggctggcacaaaacgggatcagatttataaagtcgctcctaaaaaaatcggttatctacatgcatatgcaccggctgtgaatgaaaaaggaaaagtgacttacggagaagtgtacttagtgctgaaaggaaataaacgaaaactcgtcgtgaaaaatgtcacgtcacagggaatcggcgcctggattccggttcaagatcatgtcacatttggctttcagctttcctcactgccaagataaataaaaaactgattccaactcggaatcagtttttttgtttattgggttctctcaattcggaccgcttcctcaagcatttgcacattgttttggtagagctggcgaacgagaacccgtcttactgcaaggctggcactgaaataatcatcatctttcaccatgcctttaaccgtaaattcgacgccgcgattgattttattcaatgcggtgatgccgtggatttgaaacggttctgtcggattgccgaattcatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattcccggatttgcagcgagcggaggccgatttcctccactgtcccgttgaacaagttgttgacggtgacataatcgcctttgtgcagctggcgttcatatattaagaacacaccagccagcacatctttgatcagcgattgggcgccaaaaccgatcacgatacctgctacgcccgccccggccaatatcttgccgaaatcatgcacaaataaagaaataacgtaaaagataaaaccaattgtcgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttattttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttccttcgcaagcttggtctctctccacttttcataggcggaagggaggctgtccgtctgaatgttgccaagcggcggggtatcaccgaaatcggtcacgataatgtttccgtcgaaaatgttcacattcaggcgggatcggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagtgttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcaacgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaacggcaaaaaatgagctaccataataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggctcatcagcatgcttgatgacctggaagccaaatacgaacgttttaaaaaagattgggaataaaaccgcgcgcccgctgcggtttttttattggcataaagcaacagtataaaacaaagcccctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttaattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctgatcaaacgaatgtcagatgagggccatattatcggcaaccattcctttcaccatccggatttaacgacaaaaacagctgatcagattcaggatgaacttgattcagtcaacgaagaggtttataaaattacgggaaagcaggacaacctgtacttgcgtccgccgcgcggcgtgttcagtgagtacgtactgaaagaaacgaaacgcctcggctatcaaaccgttttctggtcggtcgcttttgttgattggaaaatcaacaaccaaaaggggaagaaatatgcctacgatcatatgatcaagcaggcgcacccgggagccatttacctgctgcacaccgtatcaagggacaatgcagaagcgctggatgacgcgattacagatctgaaaaaacagggctacacatttaaaagcattgatgatctgatgtttgagaaagaaatgaagatgccgtccttgtaatgagaagagcctctcctgaaatggagaggcttttctttattttatacatttaatcagtgtggcccaatccagatctccgaagccctgttcaatcccgctttcaaaatggctcttggccagctcggcaagaggaagatttgcagaaacccgttttgcggcggcgagtgccaggttggtatccttcagccctaaagacattttgaagccggccggctcaaatttctgctcggccataatggttccgtaattttgatagactggagaaccaaagagcgcgctggcgatctctaaaaattgtttttgttctaagccgtatttctccatcattaaaaaggattcagataacgcctccagcatggacacaagcaagaaattgatgctgattttggctgcatttgccgtcttgctttcttcgccgacgtcaaatacctgctggctcaggctgtcgaacagaggcttggcagcttgctttgcttccgccggtccggctgttatgatacggagcgcggctttggctgcggcatccggtctgccaaggacaggagcggcgagaaaaaattgtcctttctctgcatgagccgctgcgagcttttctgagaactcaacactgattgtgctcatcgagatgtgaatgccgttctctgctaatccttcaagcagcccgtcttctccgaatgtcacggtgctgactgaatcatcatctgcaagcattgtgatgacaatatcagcggattttgccgccagccgtggcgtatcagctgcctgtgcgccttctgtgacaaggtcttctgtcttttgtttcgtccggttatagacagtcaattcgtagcctgcttgaagaacatttcgggcaatgggctgtcccatattgccgagtccgatgacagcaattttcaatctaatcactccctgaatattttttccattataaacaatatgaacagaatatgcatagcgatcggcttacaacaaaaaagaacagctgctcgctgtcctcatttaaaaatattgaaccatcctttatgtacaaaccaaatcagcattccaatcacaagcgcggccatcaggccaagtacagcgaaatatccgtatttccaatgcagctccggcataaagtcgaagttcataccgtatacaccggcaataaaggtgagcgggatgaaaatggttgatacgatcgtcagtgtcatcataatcgcattcatccggtttgagtttagcgtcacgtagctgtcacgcaagtcggacgtcatgtcacggttggattccacaatttcagacaactttaacaaatgatcatatatgtcgctgaaataggctttcgtttcccgctgctctttcacatggtcaaggcttaaaatccgatagagcaaatcacgcatcgggataatcgtccgtctcaaatgcaataggtctgttctgagatcaaacacctcattcatcagcgttccatacgttttgtggggacggctttcttcaatttcattcagccggtcttcgattttatacacgagaggaaaatattcatcaacaagctgatccatgatcatataagaaatatgcccgggcccttttttcaatatgtccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaagcaatcctcaatggcaagcgggtgaaaatgaaaaaaatctctcaataacgccgtttccgtatcctccgggccgtaaaaatcaacccagtaccatgcaatatcaggctgttccactcgttcgatcggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaagggtggatctcatgtggaaggaaaaagtatctgtcacgcctccgtatcattttgaccgcgtgctggacaggctgtctttagaccccctcaattctgttgatcgagaggcgagggaagtccgtgtgccaatcagaaatcaagcgggggacgtatgtattgtaaaggtacaggcgttaggccatgcgggtgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgcagggaccccgcttgttctggactacagcgtgtacaactgcatgatgaaatgcattatccaccagcagctcaatctttccttcgcttacacgctaacagaacggtttgttcatgcgtttggcgagcagaaggatggcgtgtggtgctacccaaagccggaaacgattgcagaactcgattatcaggatctgcgtgatctgcaattcagcatgagaaaagcggaatacaccattgatacatcaaggatgatcgcagaaggcacactcagcttgtcagagctgccgcatatggcggatgaagacattatgaagaaactgatcaaaatcaggggtatcggcccgtggaccgtgcaaaacgtcctcatgttcggacttggccgtcccaatttattcccgcttgccgatatcggcctccagaatgccatcaaacgccattttcagctggacgataagccggcaaaggatgtcatgctggcgatgagcaaggagtgggagccttatttaagctatgcgtctttgtatttgtggagaagtatagaataattcgtctgacaatgaaggaaatcctgcaaacgtgttatactagaaagatgtgaaaaaaccatttcactttctgccatctgcagaaagctttatatagaaacggagagaacaacgtgaaccaacaaaagaaacaggcgcctgtcgaactgaaggtcggacaaacctttccgctgacgattaagcgtctcggcattaacggagaaggtgtcggctattttaagaaaaaagtcgtcttcgtgcccggcgcgcttcctggcgaagaagttgttgtgcaggccacaaaggtccagccgaagttttcggagggccgcattaagaaaatccgcaaggcgtctgagcaccgggtagcaccgccttgccctgtttatgagcaatgcggcggctgtcagcttcagcaccttgcatacagccagcagcttcgggaaaaacgcgatatcgtcattcagtctcttgaacgccatacgaagtttaaagttgaaaacatggaaatcaaagaaacgatcggcatggacaacccgtggaattaccgcaataaaagccaattccagatcgggcgctcgcaaagcggcagcatcatcgccggcttatacggccttgattctcatgatatcgtgccgattaaagactgtatcgttcagcatccggcaacgaacaaaacaacaggcatcgtccgccgcattttagaggacttcaatgtgtctgtttataatgaaagaaaacgaaaaggcgacgttcgcacgatcgtgacgagagtcggctttgaaacaggcgaagtgcaggtcgtgcttgtaaccgcaaaagaaacgcttccgcacaaggaagaaatcgtcaaagcgattcaaaagcgattgccagaggtcaaatccattattcagaatgtaaacggggcgaaaacctcagtgatttttggtgagaaaacaaaacagctcgccggaaaaacagtgattcaagaagtgctcggcgacgtatcttttgaattgagcgcccgcgctttcttccagctcaatccggaacagaccgtcaagctgtatgatgaagtgaaaaaagcggcgcagctgaccggaaaagaaaaagtcgttgatgcgtattgcggcgtcggcactatcggcatgtgggttgcggacggagcgaaggaagtccgcggcatggacgtcatcaaggaatcaattgacgatgctaagaaaaacgccaaaaaatacggcatggcaaatgccacatacgtaacaggaacagccgagcactggctcccgaaatggacgaaagaaggcttccgcccggacgtcgtcattgtagacccgccaagaaccggctgtgacagcacgttcttggacacgatcaaaaaagtcaaaccgaaacgctttgtctacgtttcctgcaatccatccacgctcgcgaaggatttgcagacgctgtcgaaggactatcgcgtggactatattcagcctgtcgatatgtttccgcagacggcgcatgttgaagcagtggcgagacttgtattgaaatcgtctaactaaaataaacaatactaatcagacctggatttcggtaaaataaacaattccgatttccgggtctttttcgtgcgcagcccttgtcctgactgtctttcccaaattttatcttccttcttttctcggagatctttattttaactggcgaaaagaattgaacaaacgtgttgaaaagcgggtgaaaaaagcgttatttaaccggaaaaatttccttccagtatgattaaaatacatgagtaaaatgatgtaaaatcatagatatatttttcataatttgtaaaattatatattaacttgcagttattacgtgtgaaatattgatgataggaatataaggaaaggtatggcgtatatcatttcaagagtcattcgatgtaaaaagttgaaacattgtaataaatgaaagaggtgaaaatgatggccaaccccattttaaaatgcataacgtatgagcactacaacaattaaataatagtgccgagacgataacaactattacagtaatacctacaatggttatatccttgagacaattatgcttcataatataaattttagattgacacttggctaaaaagtattgcagagaaggaaatggataactaaatggataaagtatataaaaaacgaccgttatataaaagaagttggtttcaaacatttttggcatttttagtatctcagctttattttaattttgtagaattaacgggatggggtcctaagtatagagaaatgaatggattcccagcaaacataggtgaactagatttctttcaaacatatctttcattctatgataatccatggtttaatattattactgttttcttgggagttttcactattatacaaataattacagggataacaaaggatattcgaaattaaagcaataacttctgatgccttatttaatgatgaaagaaaatgaacactttcttaattatcttatgagtgaagactgcgacacttagtcagcagtctattttattggttctggatcaggattaccgaattataactctatagtaggttgccacttgctgcgttggttattttctaaatcatgagcaaatcccaaacgatccagattgaagttcttgaattctttaaaataagggtttattttctcttctcatcctctttactccatgtgattcataagtggtagcagtagcttaagtaggttttttcattctcttgagtactagttataccacccccaactcaatttgcttaatcaaagtttatctcttgaaattagtttttccgcaaatatgatatagagatacggatatggtgtagtgttaaatatcttatcttcaataacagggcaattattttgcgttggtaatatggagaactcatatgatattctatttaggttggaatcctttttatccaaaaagttcaaaagcaaggccactaagaaagacgaaggtcagcgccagtgttaaccacaatataaaaaataggtatagatggtcatcccacgtgaaatgttcaaaaattactatagattgataagaaatgctttcgcatgcgataagtgtaaaaagaaagcatggtcagttttttaatattgagatacaggtatagccgtatcccctaatgaaaggatttgattttgttatgacagaaaatttctggcgtgaattaccacggccattttttgtactggcaccaatggaagatgtgacagatgttgttttccggcatgtagtaagtgaagcaggcagaccggatgtattttttacagagttcacaaactcagagagctattgccatccggatgggaaggatagcgtacgcggccgtttaacttttacagaggatgaacagccaatggtagcccatatatggggagataagcctgaaaacttccgtaaaatgagtattggcatggcagagttaggatttaaaggactagatatcaatatgggctgcccagtgcctaatgttgcggggaatggaaagggaagcggccttatttgccgtcctgcagttgcggcagaattaatacaagctgcaaaagcagggggattgcctgtaagcgtgaagacaagacttggatacacggatgtggatgaatggcgcgagtggctgacacacattttgaaacaggatattgccaatctttctattcatctgcgtactagggcagaaatgagcaaagtagatgcgcattgggagctcatcccggagattaagaaacttcgtgatgaggtggcaccagatacacttttgacgatcaatggtgatatccctgaccgccaaactggcttaaaacttgctgaacaatacggtgttgatgggattatgattgggcgtggtatttttacaaatccatttgcctttgaaaaggagccgaaagagcatagcagcaaggaattgcttgatctcttaaggctgcatctggatcttcatgataaatattcagcattagaagcccgtccgtacaagcctcttcctcgttttttcaaaatttatctccgcgggttccgaggggcaagtgaattaagaaatcaatgcatgaacacaaagtcaacagatgaagtgcgtgcattgctcgacgactttgagagaaagtatcttgatggggtagaataacagcagtgcttgattcaaaaaaggctaacaaaataaagggatttttacaccattcttgactaaaataaacctggattttcggtaaatccgggtcttttttgtacgcagcttttactcagcctgtcttttctctaatgtattgtaagaaaataatggtatatttagtggagatatcttataaagggggagaggaaaatgaaacgactatgcatcatcccctgcggcaagaaaaaaatctgggacgtccagcctgatgccgggccggtaagagcagaggacgcttatctcagcccgtttcatcaggcgtgcgaacggtatgcgaaagcatttttcgatgagtgggtgattttgtctgcgaagcacgggttcctccgccctgatgatctcgtttcgggaaattacgatgtcacttttggcaccggtcatccggaaatcatgacagcggacgagctgagccgccaatttcacgaaaaaggcttttctgatatcgaagagctagtcatgcttggcggaaaaaaatatcgaagcgttctaaacgccgtcatcggagaacaccagcatatcagctggccgctatcatcttacaaaggcataggctatatgctccaagcgctgaaccgggctgttgaagaaaagcatgaactgtagcacgtacatatgaggaaaagagtgggaacatgaaaaaacttgtgtttggcttgcttgccattgcattattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcataaagtaacgtgcgatggaattgaagaagcgtataccgaatcagtagcaaaacatgtaaatgaagaagcatcgaaggcaatcgaagcagatctgaaaaaaacggttcctcgacttataaaagctgatgctgctttgagtatcgaaaacggacagttcacgttagatacaaaatggaacaaacagctggctgaaaaagcgcctatgagtatgacgattcagttagacaccagcgggttatcaaaaacagatgccgcaaagatggcggaaacggtcagaaaaacgcttaatgaaaagggatacacatactcaaacggcacgatagactgtatgcagaaggacggggacggcggtatcggatatgtcaaatattcaattgattttctttcaaaagcagctattcagtcaaacgatgcagaggaactaggaagttaaaaagatttccaaggaaataaatacgtcgatcattgtcaaaggccgggtgatatccggtcttttttgcatgctgtaaaacgagacaaatgaatcagtttgagacaaaacgagacacacgtctcaaactgtctccaaggtgaagacgagaagactgattttacgggctcaaaagactggcacacttcttgcatttttaatggtgaaccctaaatagaaggaggcgcacaaaatggaattgttaaaacgagagggcttgtcattaactgaggaaaaagcgctgtggatgtaccaaaagatgctggagatcaggggctttgaagacaaagtgcatgaactgttcgcccagggagtgcttcccggattcgttcatttatatgccggtgaggaagccgtggctgtaggggtgtgcgctcatttacatgatggcgacagcattacaagcacacacaggggacatggacattgtatcgccaaaggctgcgatctggatggtatgatggcggaaattttcgggaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtatttgttgctgaaaacaacggctatggcgaagctaccccatttgagtatgcatcagcctgtgattcaatcgccgatcgggcggctgcttataacatgccgggggtgacagttgacggcaaagatattttagcagtttaccaggcagcgaaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaaaattcggagctgctggcagatgtgtacgtgtcatatgaaaaaggaggaatgtaagagatggcgagagtcataagcatgtcagacgcgatcaatgaagcaatgaagcttgcgatgagaagagacgaaaatgtgcttttgatcggtgaagatgtcgccgggggagcggcggtcgatcatttgcaggatgatgaagcatggggcggtgtattaggggtcacaaagggactcgtacaggaattcgggcgtacacgagtgctggacactccgatttctgaggcaggctatatgggagcggctatggctgcggcatcaaccggtttgagaccgattgccgagctgatgtttaacgattttatcggcacgtgctttgatcaggtgatcaaccaaggggcgaaattccgttatatgttcggcggaaaagcgcaggtgccgattaccgtccgcaccacatacggagcagggttccgggccgctgcccagcattcacaagcgctgtatggccttttcacgagcatccctggactgaagacggttgttccatccaatccgtatgatgccaaaggtcttctgcttgcagcaatagaagataatgatccggtgttcttctttgaagacaaaacgtcctacaacatgaagggcgaggtgccggaagattattatacaattcccctcggaaaggcggatatcaaacgcgaaggtaaggatgtcacgctctttgcagtcggcaagcaggtcaatactgcacttgaagcggctgcacagctttcagagaggggcatcgaagccgaggtccttgatccgcgcagtctgtcccctctggatgaggatgcgattttcacatcgttagaaaaaacaaaccggctgatcatcattgatgaagccaatccgcgatgcagcattgccacggatattgctgcgcttgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcaatgaattaaaggggaacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatagaagcgcctgaaaaaggaacgctgatcgatatcaaagtgaaagagggagaagaggttccgcccggcacagcaatctgctatatcggggacgccaatgagtcggtgcaggaagaggcgagcgcgcctgttgctgaagacagtgtgccgcaagccattcagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaggcaaagcctgtttcggagcagaaagcgcaggaaatcccggtgacaggcatgagaaaggtcatcgctgcccgaatgcaggaaagcttggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcattatcacacatccccatgtacaccttggtatggctgtagccttggaaaatggcttagtggtgcctgtcatccgccatgctgaaaagctatcgctgattgaactggctcaatccatctcagaaaatgccaaaaaagcacgcgagggacgtgcgggaagcgaagaactgcaaggctctaccttctccattacaaaccttggcgcgtttggcgttgagcatttcacaccgatattaaatccgccggaaacaggcattctcggcatcggagcaagctatgacacaccggtgtatcaaggggaggagatcgtcagaagcacgatcctgccgctcagcctgacatttgatcacagagcgtgtgacggcgcccctgccgctgcattcctgaaggcgatgaaaacatatttggaagaacccgcagcattaattttataggaaaagcaggtgaaaacgacatgacattagccattatcggcggcggacctgcaggctatgcggctgcggtttccgcggcacagcagggcagaaacgtgctgctcattgacaaaggcaagcttggagggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccggaaacaacaggttgtcagtcagcttgtccaaggcgttcagtacctaatgaagaaaaatcaaatacaggttgtaaagggaacagcctcctttctttctgaaagaaagctcttgatcgaaggagaaaaaggaaaagaaatcagagaggcggaccaagtattgattgcctccggatcagagccaatcgagctgcctttcgccccgtttgacggcgaatggatcatcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgatcccggctgaagatgaagaaattgcccgtctttttcaggagaaacttgaggaagacggtgtcgaagtgcatacctcatccagattagagcgggtggatcaaacggccaaaacagcaatatggaaaagcggtcagcgagagtttaaaacgaaggccgattatgtgctggtggcgatcggcagaaaaccccgtcttgacggattacagctggaacaggccggagttgatttttctccaaagggcattccggtgaatgggcacatgcagacgaacgtgcctaatatttacgcgtgcggagatgctataggcggtattcagctggcgcatgccgctttccatgagggcatcatcgctgcttctcatgcttccggaagggatgtcaaaatcaatgagaaacatgtgccgcgctgcatctatacgtccccggaaatcgcgtgtatcggaatgacagaacgacaggcaagaagcatatacggggatgtgaagatcggcgaattttctttttccgcaaacggcaaggcgctcattaaacagcaagcggaaggaaaggtcaaaatcatggctgaaccggaattcggcgaaatcgtgggtgtctcgatgattggcccggatgtaaccgagctcatcggccaagcggcagcgatcatgaatggtgagatgacggcagatatggcggagcattttatcgccgcccatccgactttatcggaaacattgcatgaggcgctgttaagcacgatcggccttgcggtacatgcataataaaggaaaaagcaggcacatggatataaggcgcctgcttttttatgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgcagagtcatggcatcgctgcaaaaaagctgaggtcaatccttatctagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctgttaattgattcagacggtgttgttctggcattggacggccatccccgcgcgctctatgaagccaaacgcatcaactttgttgaaggggcatgctggacggaaacggctgtcggaacaaatgcgattggcacggcgctccacatcagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaactcgcagcaaaaagccgtgagaaagagctcgagctgatcagccgttttggagagagggctttatccagtgtgccgatggtgctatgcaataacaagcagcacatcatcagtgcgagcataccgattcgaacctcaatgccggattggcagggccggcacctgtatgagttgaaggaacggggctactcaatcgaaaaagctatcaccataggagatggcggcacttgtttttatctttcggaacaaaagaaaaagaaggtgtttcgattcaatggagtgatcgggaaaagcggccgatcgcatgcgatgctgatgaaccttgaacgtgcagctgcggcagatgcaacggtctgtttgtcgggcgaaactggtacgggaaaggaagtcgcagctcgcgcgcttcatgagaacagtgagagacggcacggtccgtttgttgctgtcaattgcggagcgattccgtctgatttgattgaaagcgaactgttcggctatgcagagggcgcttttacgggagcgaaacgaaatggctataaaggcgcctttcaaaaagcgaatcaaggcacattatttttagatgaaatcggagaaatttcccactcgatgcaggttgcacttttacgggtgcttcaggaacgcaagataacgccaatcggcgggacgaaagaaattccagttgatatcagagttattgccgccacgcattgtgatttacgcgagcttgccgaaaacggaaaaatcagagaggacttgttttaccgtcttcacgtctatccaattgaactccctccattacgcgatcgcaccgaggatatcccggatctctttgagtactacaaacagaagaatcattggccaggcgaacttccttctgatttttgtaatgtgctgaagcaatggaagtggccggggaatatccgtgagctgtttaatgtgtttgaacgtctttctatcagatttccggacggccggctgagggatgaatcgcttcccgctttactggaagccgctggattgccggccagctctgcagaaaaaaagccggctgctgccggcgtgcttacttttcgtgagcaaatccaaaaggatatgatgatcaaagcgcttgaatctgcaaaaggaaacgtctctcaagccgcaaaaatcagcgggatccctcgaagcactttctacaaacgcctgaaaaaattcaacttgtccgctgaatcataaagcatacttccttcgggaaatggaaacattatgtatgaaggagggtgttacgatgaatattcaaagggcgaaagaaattgtagaatctcccgacatgaagaaagtaacatataacggcgttcctatttacattcagcacgtaaatgaagaaactggaacagcaagaatttatccgcttgacgaaccgcaagaggagcatgaagtgcagctgactaacttaaaagaggattaaacaaaaatggcccgcttcataagcaggccattttgttatccgcgcggcgcaaataaaataacacagacaccgatgagacaaatgaatgcgccgatccagtcatacagatcaggtgttttccggtcaacaagccatccccacaggaccgcaagcacgatgaatactccgccataagcggcgtatacacggccgaaagatgggaaggactgaaacgtcggaagaatgccgtatacaatgagaatcagcgccccggcgattccatagccggctggctttgcctctctcagccatagccaaaccagatatccgccgccaatttcagcaagccctgccgcgagaaataaaagaatggtaatcagcatcatgagcactcctcaatttgcatttatctttcattatagaggaggagagcttttaaagcttcggatgattctcaaattccttcaaatacgcttttcgctgaacctctgtaaattggctgatccaattgttttgagcctcttcactcaaatggggaaggatatagcgttcaaccgcttcgaaaaacagcggattcgcgatgatgttccaggtcgggattcgaacgattttgccgtctgttttctcgatgataatatcctcaaaaaagatccctttcaaactgtattgatggcgtcccatataaagccgcttcacctcggaaaacagcacgctgcgctttctcgagaagatttcgccactaggtccggtctttatggtgaaaatgacatttccacggcttgtgaacgcaggaaaagccataaagaatgtgatcaatccataaatcatcgccagtaatccgccgcccaaataaagcagggcatatttagattcaaacgtgagggcttcagacaccagccagactcccacaataaaggcgccccctgtagcgaggaacagccaagcccttagaaacatcatgctttttacttcaatcatgtgctgcccctaaagcttcggatgattctcaaattccttcaaatacgcactgcgttggatgtctgtaaactgtccgatccaattgcttttcgcctcttcattcagatggggaaggatatagcgttcaaccgcttcgaaaaacaacggattcggaatgatgttccaagtgggaatacgaatggtcttctgatcaacggtttggatcaatatatcttcctggaaaattccttttagactaaatttatggcggctcatctcaattttcttgatatcagtaaacgtaacagacactttgtcagtgaacacttctccattttttcctgttttgatgcggaaaatggtatttccccgcggggtgaaagccggaaagaagatgataaataaatataaacaaaacaaggtgaacagaaagccagcaggaatggctaataggtaatatttcgtttgaaacgtaatacccatataaaagagccacaaacatgctaatcccataccggcagatccgacaaaagcccatattctcaggaacattttgcttttgacttcaatgatttcttggtttttcaatgcttttctccttttgttaattcaattcttatcattgtgaaatgatttgatttacaacatccttatgagcagggaggatagaaaattcattctgggtgatgcctgtgacaagccaagtatggtgggcccccggcaggacaaatgccatgtcagccacttcaggagtgttatctttgccatatgccagacgcataagtgtatccattttccctttccgcaaagccagatcatttgcaaatcgggtaacgtcctcttggtggtcatgtttttcaaggaactcttttagatatgaagggttgtctgaagcgccctccaagagtttttcaaattcatttgatgtcaatgtcacaatcgattctcttttatcctctgtatctattatatgtaaaaactcatctgtcttagcaagtaacccttcacttgattccatttttgtaatgcgatggacttgttcatcaaaaaggagttcgtgagagtaggtgccgaattttgatacatggcaggacacattctgttcggcgccttgcccgttaaatttagaaagcttcactgtatagtcagcgtcgtttaatacatggataaacggacagtactcgtcctttaaccgatattgatggttccgatattccgctgcatccttggctaagagtgagcggcacgcggcttcaaataaggcgccgagctgttcatcttctatttccggaaaataggcctgcttcaaggccattccctgttcaaaaaacccttcgctgtaaaagcaaaacaagagttcttctatgctaattgtaaactgcttcattgtttattctcctatccaaatgaaaatttccctttaaggaaatgggttgcgccgtgtatgagcgaatccgctgttttctttgctttttccattccttttttcgcgctgtctatccctttatgtatcgatttattcgccgcatctatgccgtcattcactgatttgacgaatttgccggctgattccagcccttttttggctgtatcaacgacagcatggatcggttctttcagctttaaggctgctttttcggcaaaaccggctgtatatttggcgatttgttctccgacgactccgccaatgtatgaacctgctgccccaagaaggacagtacccacaggtcctgcaaagcttccaattgcaccgccgatgacagcaccagctgtggcaccgcccgcaacaaaaatcgtgttattcacagcatttccgacggccttggcgttttcacgcttgagaacttccggtttgtcctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgaggaaagtattttgtaaactttttatgtaccaaatctgaaaatggacggttggtcttttttaacaaatatttaggattcaaaagcactcttgccgctttttgataacgtgagctgtcaacggccctggaaatatccaagagcagttttgagtgctgggctgtatgcaagccgcttggctgtttcacaaatttcgtaagccctaatccgtaatattttccctgcgtcagcataagagcggttaagcttgtcatcgtaccgtatttgtcgtaggcattgtagagctttcgcaaaatatcatcttgttccacaaatttatcgcccgtttttctgatgaaaatctcattgtcactcagcttggtgacgagcgcctttcctgagctccacgcatcgcccactccagagaaacagctgctgtagcggggatcgcattgcaaaatcatctgccccagctccacatgcagatccttatatttgttttccatatcagttaattcagtgacaacatcatttgcaagctgttcgagcttatccggatcaactgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgcttttccttgccaagcatctcccattgcagataaccgggattcaagcagcattttggagcttctgacctcttctgcggccgcactgtacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaaaaaaacaaatccctcagacataaggcaaatgagaaatttcccgctctatgggaaaaaacactaaagttgatcaaatgacctaagtgcgccaaacgtgttacgggacgggctatctcatggtataaatggaattgtaaacgttattaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgtgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgatgcgtggatgctcaattattccaatcccgcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaggcgagctggaatgacacattcgccaaagcgcgtgacgtgcaggccgcagatcctgacacactgccgaatacgtatttgcaatattatttgttcccggatgatatggtgaaaaaatcaaatccgaatcatacgcgggcaaatgaagtgatggaaggtcgcgaagcttttattttcagccaatgtgacatgattacacgtgagcagtccacggaaaacagcgaaatcaaaatcgatgaccacgcatcatatatcgttgatcttgcccgggcgattgcctacaacacaggtgaaagaatgatgttgatcgttgaaaataacggcgcaattgcgaactttgacccgactgcgatggtcgaggtgccatgcattgtcggctcaaatgggcctgaaccgattaccgtcggcaccattccgcaattccaaaaagggcttatggagcagcaggtatccgttgagaagctgactgttgaagcatgggcggagaaatcgttccaaaagctgtggcaggcgctaattttgtcaaaaacagtgccgaacgcgcgtgtggcaagactcattctcgaggatttaatggaggccaacaaagacttctggcctgagcttgatcaaagcccgacccgtatatcataactgaaattcccccattttcgaatctgtaattgtatataatagaaagaaaatggggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagcggctacagtgaatttcgcgtctttttaaagtgggaagatcagccggaagaaggcgagaatatgagttttcaaaagctgcttgatgatattgaagcaaatttgaagttcttacggacaaaggacatgacggacatgtgccagctgattgatgcagcggaccgcattttcgtctacggttcaggaaatgcgcaaaagatatgcgcccgcgacctgcaaagaatgtttattccgcgccatcgctatcttattttaatagaagacacaaatgaatttaatctgatgcgtgatgattttaaagtaaacgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgagtagcagggggttctggtatgatgcaaaaaattcagcgctttggaagcgcgatgtttgtgcctgttttattattcgcgttcgccggcattatcgtcggtatcagcacgctctttaaaaataaaaccctcatgggcccgctcgccgatcccgacggtttttggtatcagtgctggtatattattgagcagggcggctggactgtttttaaccaaatgccgctcttattcgccatcggcatcccggttgctttggcgaagaaagctcaggcacgcgcttgtttggaagcgcttactgtttacctgacattcaactattttgtcagcgcgatattgacggtatggggaggagcatttggcgtcgacatgaaccaagaggtcggcggaacgagcgggttaacgatgattgcaggcattaagacgctagataccaacattatcggggccatctttatttcttcgattgtcgtctttttgcataaccgctattttgataaaaaactgcccgattttctcggcatctttcaaggctcaacatatatcgtgatgatttccttctttattatgattccgattgccttggctgtgtcttatatttggccgatggttcaatcgggaatcggctcgcttcaaagcttcctggttgcttctggggcggtgggcgtttggatatacacgtttttagaacggattttaattccgaccggccttcatcactttatttacacgccgtttatttatggcccggctgtagcggaaggcgggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccgattgagtttacgttcttattcatttcacctttcttatttgcggttcacgccgtgcttgccgccacaatgtcgacagttatgtatatggccggcgtcgtcggaaatatgggaggcggactgattgaggcggtgaccttgaactggattccgctctttggcagccacggtatgacatatgtgtatcaaattttgatcgggctctcgtttacagcaatttattttttcgtcttcagatttttaatcctcaaattcaatatcgctacaccaggacgggaaaaggatgaacagcaggaaacaaagctatattcgaaaaaggaatacagagaacgaaaaaacaaggatgaaacggcctccgctgctgaaacggctgatgacaccgcttttctgtatattgaagcgctgggcggaaaagacaacatcactgaagtcacaaactgcgcaacccgcctcagagtcagtgtcaaggatgaaacaaaagttgagtccgacagcgtattccgcgcgcttggcgcacacggcgttgtcaggaacgggaaggcgtttcaggtgattatcggattaagcgtaccgcagatgcgggagcgtgtggaaaaattactgaatgaatagtcaaaattattttatcttgcgctgtttaaagacagcgcttttttgtttgtcatacgtttgccacttataagtgcaagggatgttatgtttcttaaaaactgaaaccaatagggggagtaaaaatggaaaattatacaacgtttttaggtctttacaaacctgaaagcactgaaagtattgaaattgattccaagcttgccgagaatttcgaaacgattgatagtaaaattgggattgcattaagtaatggaataacaacttttgaaaacttaaatgaaagactcaaaatgtatgagaacagatttgagtaccttgatgaacgaaacgtaatggattatggagctaaaggagacggggtcacagatgatacgcaagcatttcatgatgcgatggccgaaggcggttatctcataaaagtccctgcaggcgtatttagggtatctggcttgctcgttccttcgaatacaatgctggttggagcgggtaaaaaaagaaccatcatcaagttattagacgatacgccagttggtcactctgtactcaccaatagtgatcatacaaatggtaatgaaaatatctacattggacatttgacactggactggaataaagatacgcgtcctgctggatggaagatccctaaggggcccacttcaagctgcttgctttttgcaaatgtggattactcttttgtagagcatgtttttgcaaaaaatgccggccttcacgggtttgatgctacaagccctaattataacagacacggagaaaatgatgatcctaccttttatcagcctggtggctgcaactttgtaaccttctcatattgcgaagcaacaggctctggcgatgataatttcacatgtcactttggaaagcatacgactttcagtcattgtctttcttaccatccgatggggttaaatgatgggtcttcaaatacaaactgttttgaaatcgatgatggctctcaggatgtaatgattgatagctgcatcgcaattggaggagttcgaggatttgaaattaaagctcatgattatgctccggctgcaaaaagagttcaacttgtgaactgccgtgcctatgaaaatgcaattagtttttgcattcggcatataggacaccacacagcaagtgatcctcaatcagcatcagctcatgacgttcagctggctaactgtatcgcatataaccctaagccgagtgatctgtacaaaggggcagggccgaatgcattgcaaatttcaggttacgatggcgtcaatgtggttaattttcatgctatatgcgatgattcctccattaactataagggaaattcagtcgtaagcgtgtattataaagggcgtctaatcaatttaaagaatataacgattcgaggatttaaaactgctgataatgatctttatattgtaggtggcgacaattctgtcggcaaggtaatgattgatggtgtgacattgatcgattcagccgaaaagggtgttgtttttgggagcggtatgtacgagtctgtagttagtaatgtatgggggcaaagatcgcctaaaaataacagcggtacagttgggattttttctgttgaccctgatcttaatgtttctaattgtgacttttcaggctacgaaacagattttaagattggcggcgttgtgacgccgtactttttgtttaaacataaaggaagcgggattattggctctcgtgattcccacgctactggaaataataattttgtagcaggatctgttcgaagcagagcaactggggctgctcaatcttctgtgatagcctcatataatacgatcaatccgaactcagactcagttgctctaggatgggcaagtgggagcacaccatcctcatcaaacagaaagatagaatttcatgcaaaagatggaacgattaaggcttcaggaagcataaaaagttcccaaacgttctcggattacgctgaatattttgagagcctaagcggtgagaaaattccggcaggaaccctagttactttggagggtgataaaattagacctgcaaaaaaaggtgactttatgcttggagttatttctgaaacagctggtgtgatacttggtgagtcaagcttccattggtctggaagatacctgaagaatgattttggcgggtatatttatgaaaaacagaaagatgccaatggccaaatcgtcatggcgcctatggaaaaccctgattataagccagataagaactatgcctctagggaagagagggatgaatggaatgttgtgggccttgtaggacaggtttatgtaagatgcgacagcacagtagaagccggagactttattcaagcgcataacaacggaattgctacaaaaacggtatctcctaaacaaaggtggcaggtcatgagagtcatcaaagagtttgacaaaagtaagggatatggagtggttttagtttttattcggtaacattaaaatgtacagattctaaatagagtgcttaacaatgcactctatttagagttttaattagattttagaaatttttcaccgcatttttatcagattatattcctcgcaaaaaggtcttcgttttaaaatttatctttttcattattcctacggttccagcaatcttcctaatttatctaagtctatccagcgcctcaactttagtagagtaaaatctttgatattttttaatgaacgcagatcagcagtgaatagctctcgaataaaagataaagtgattttggttatcgataaattcagtgcttttctatgctttcataacacttcatgacagtaaaattctttcatcaagccttataaacaattaaaataaaaagtacatattgctaaaaggggtttggaggcttttacatgcaaaaggctttgtcgtttttaaaaccatattcattgctggcgggaattgctctgattcttatgctgacggagcttgcagttgaacttatacagcctttattgattgcaaaaatcatcgacgatgggatattgaagcaagatctgcggcatgtatggatatggggcgcggtcatgatcgggctgaccgtgttatcctttgcggcggggatgctgaattccttttatgccgcccatgtcagccaaagcttttcctatgatacgagaaaagggctttttcaaagaatccagtccttctcctattccacatttggacagttttcgtcctcttcttatattacaaggctgacaaacgacgtcacacaggttcaaaatatgatttttatgagtttgcggtttatgctgcgggctcccttaatgattgcaggcggcattgtgctgtcgcttgccgttaatgtgaaactcggcttttttctgcttgtgaccattccgatcctgatcttgtttttgctgtgggtattaaggaaaggcggggcgctgttccgctcagtgcagaaaaggctggatcaagtgaacaccatcatgcaggaaaatttaatcgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgctgctgatgaatctctgcattcttttgattttgtgggcggggtcctacagtatcacgagcggaagcactcaggtcggcgatgttgttgcgataattaactacgcaacacgaattacaggcgcgctttcgatgtttccgtttttgattatgattttcaccagggcgaaggcttcaggggatagaatcggcgaggtgcttgaaacagaaggagatgagcgggaggaaggcatcatatctgatcgtttgtcaggacggattgagtttcagcatgtatcctttcgctatcctgaaatggacagagaagcgctcaggaatgtctcattttccgcaaagccaagagaaacgatcgcgattctcggtgcgacgggctcgggcaagtccacgctttttcagctcattccgcggctttatcagccggattcaggctgcatttacatagatgaaaagccggttcaagattttccggctgaagggctgcgcaggcaaattggatatgtaccgcaggaagtcctcttgttttccggcacaatcaaagaaaacatcgcttggggcaaagaaaatgcttcactagatgaaataatggatgcggccaaacatgcgcaaattcatgaaacgattttgaagctcccaaatggatatgatacagttttggggcaaagaggcgtcaacctgtccggcggccaaaagcagcgaatttccattgcgcgggcgctgattcgaaaaccggctatccttcttttagatgacagcacaagcgcgcttgacctgcaaacggaggcgaagctgcttgaagcaatcagcacataccattgcacaactttgatcattacacaaaaaataaccacggcgatgaaagctgatcagattttgctgcttgaggacggcgaactgattgaaaaaggcactcacagtgagctgctttctgaatctcagttatacaagcgcatttacgagtcacaattcggaagggaggggagcgagtcatgctaaaagacatccgcaagcctttccaatatcccaaactgccaattgacaaaaaagaaggcgcgaaaaagcgggcgaaagcaaaggatacaaagggcacactgagacgaatctggtcttacttggctgaaagaaaaggactgctcatacttgtcatgctaatggttgtcatcagcgccatattcgggctccttggcccctttgtgatcggaaaggccatcgaccattttatcgtcgggaaaacggtcagcggcttgattcccgttttgcttcttctgctcgctatctatatcattcagtctctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacattgaaaatgtcagttctaccttaaacacgtcagtcattcaaattttgtcaagcgtgatcacctttgttgggaccattgcagtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaatttctcgaaaaaaacgctgcactcaagacgtcgggcttttgggcgcagacgatttccgggtttatcccgaaggtcatgaactctttgaataacttaagctttacaatgatagcggcaatcggcggtttgtttgcgctgaaaggctggatctcgatcggctccatcgtcgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgcggggcagtccatcgcttttgtcggaccgacgggggccgggaagacaaccgtcactaaccttctcgcccgtttttacgagcctaacgaaggaaaaattttaatcgacggtacagatattaaaacccttactagagcaagcctcagaaaaaacatggggtttgttcttcaggattctttcttatttcagggaacgatcagagaaaacattcgctatggcaggctcgatgcttctgatcaggaagtcgaagccgctgcaaaaacagcgaatgcccatagctttattgaaaggctgccaaaagggtatgacaccgtgctgacgcaaaacggttcgggcatcagtcaaggacagaagcagttgatttctatagcgcgggcggtgcttgccgatccggttcttctcattttggatgaagcgacaagcaacattgataccgtaacagaagtcaacattcaagaagcgctcgcccgtttaatggaaggaagaacaagcgtcatcattgcccacaggctgaacaccattcaaagagcggaccagattgtggtgctaaaagacggtgaaatgattgaaaaaggcagccatgacgagctgattcggcaaaaaggattttacagtgacttatatgaaagccaatttgagaaatagacctttgtcctgcacagaggtcttttttgttacagttttatagtacttttatttcattttcgtgaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttcctagctttatggcgtatgtcatcgcagcgattgaactcattggcggagtgcttgtcttcttcggattggctacacgtattgtcggtgtactgttcgctcttacactgatcggtgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacggaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagcggaattaacggctgacggaaaacgcgtactgcttattcttgaagaaaatccgagcgctgtcgtcttgcctgaacggtctgtgacaggcctttatcactttgcgattcttcttccggacaggaaagaacttgggatcgcgctcgcccgcctgattgaacacggcattgctatcggacatggagaccatgctgtcagcgaagcgctctacctgtctgatcctgacggaaacggcattgaaatgtacgctgaccgcccccgcagcacgtggcagcgtgatcgggaaggaaactacgtcatgacgacaaccgctgttgacattgagggccttctggaagaggcaggagatgagcggaaaacatcgcttccgaacgatacaatcatcggacacattcatctgcatgtcagtgatttgaaagaagcaaaggcgttttatacagatgtactgggctttgacattgtcggaaactatgcgggcatgtccgccctcttcgtttcagccgggggtaccaccatcatatcggcttaaacatttgggcgggaagaaatgcgccgcctaaaccgacaaatgccagcggactagactattacactgttgtcctgcctcaccaagaggagctggatttagtggcaaaccgagtcaaacatgccgggtattcgattgaagagacggaaaacagctttcgtgtgaaagaccctgtttccggcgcctatattacatttgtgatttaactgcaatccccttgccgaaaaaacggcagggggattttttattttccagaaactcctgtcaaaaatgccctgaggcaggtatgataagaagggaattgggtatcgggagtgatgagcgtgaaggctcttttttttacgagaatgttcaccttgatggtgagctgtttaatgtatctgtccattgtgaaagaggatgactggtttggatatgtatttatagcagcaggtgctgccatgtatgcagccaatcatgttttgctgacaaaagagacaaatgccatctggttttgtctgattgatattgcaatcggcttttcgttcggatttatatttcccggcacaggtttgttcattattatgctttgtccggttgcggtcgctttttttctgcgggggtttcctaaaagaacagcatggtctgtcttatgtctttcctctattttatttttgaccgtcctcatccgtacatatgcgatgttcggcaatgaatttgtcattgatcatttgactagcatgacattcgttgtcttctgcggtgtcgtgggcaaattaatccgcaagctgttggatgcgcaggatacggcaaaacagcagtttcaggaactgacggagtcccatctggcgctgtctgctgcacatcaggagctgcatttatatgcgaagcaggttgaagagctgaccgccatttacgagcggaacagaatggcgcgggaaatccatgatacagtggggcataaaatgacggcccttctcgtccagctgcagcttttgcgtgaatggcaaaaaagagacagccaaaaagcggatgagacagtaggtgtctgtgaaacacttgcccgtgaagcgcttgatgatgtccgcttatcagtacgcactctgcaaactgaaaacgatccttcgctaatcgaatcgctgaaacagctgacagaggacttttgcaaaaatgcaggagtcacaacagaatttgcggtcagcggtgatcctgcaatcattccgctgtctcttcatccgaccctgatcagaacggtgcaggaagcactgaccaatgccaaacggcacggcggcgccacagcttgttcgatacagcttgcctgcacaacggacagcatcagccttgtcattaaggatgacggaaaaggcaatcccgaagcggcacttggctttggcctcttgaatatgaaaaagcgggcagcggagcatggcggaacgatccgctttgagagcgaacgggatcaagggtttactgtaatcgccgaattttcactggctaataaaaaatggagcttcgggcccgcacagcaaaaggagaatttatcatgattaagatcatcattaccgacgatcaggatatcgtcagagaagggctggcatccctgctccagctccgagaagagctcgatgtgatcgcaacggcgcgaaacggacaggaagccttcgaaaaggcgaaagagctggagccggatatcgtgttaatggacatccgcatgccggtttccaacggggtggagggaacaaaattaatcacaagctcgctgcccggcgtaaaggttttgatgctgacaacctttaaggattcagcgctgattgctgaagcgcttgaagaaggagcaagcgggtatctgctgaaggatatgtcggcagatacgattgtaaaagcggtgatgactgttcattctggcggaatggtgcttccgccggaattgactgcccaaatgctgaatgaatggaagcgtgaaaaacagctgaaaggaataaatgagatagaaaaacctaaggagctgctcgacctgaccgagcgcgaaatcgaagttctggctgagctggggtacgggctgaataacaaagaaattgccgaaaagcttttcattacagaaggcacagtcaaaaaccacgtttcaaatattatcagcaagctggctgtcagggacagaacccaagccgccatttactcggtcagatatggtgtatctgtcttttgacatatgacgttttgcatatacgcttctctgaaaaggccttttacaggcctttttttcatgccctatgttctatctgccgctacatgccgcacgcctttctttcttctacaatggcaatggatcaaaaaaaggagtgagacgacgtgctgcaagcagaaaacatcaaaaaggcatatgaaaaaaaaacaatcgtgaaaggtatttctttttcccttcaaaagggggagtcgttcggtctgctcgggccaaacggtgcggggaaatccacaaccatttcgatgatttccggccttgtaccgcatgacagcgggaacatcacggtgggcggctatgtcatcggaaaagaaacggccaaagcgaaacaaaaaatcggcattgttccgcaggaaattgcattatatccgacgctgacggctcatgagaatcttatgttttgggggaaaatgtacggacttacgcacggtgcggccaaaaaaagagcggcagaggtccttgaatatgtcggtctgactgagcgggctaaagataagattgaaacattttccgggggatgaaacgaagaatcaacatcggtgcggctttaatgcataagcccgagctgctgattatggatgaaccgactgtcggtattgaccctcaatcgagaaatcacattttagaaacggtcaaacagctcaacgaaacgggcatgacggtgatctatacgagtcattacatggaagaagttgagtttttatgcgaccggatcgggataattgatcagggggaaatgattgcgattggcacaaaaactgatttgtgcagccgccttggaggcgataccatcattcagctcacggtcagcgggatcgatgaagcgtttcttttggcgatccgttccctggctcatgtgaatgatgtaacagtccaagagtcagagctcaaaattgacatttttgctgctcatcatgagaaagtcgtcaccagcctgcttgctgaagctgctactcatcatataaacctgctgtcccttcaggtgcaggaaccgaatctggagcgcctgtttctgaatctgaccggccgcacgttgcgggattgaggagggacggcaatgaaaaaaagcatatggatcgcatggaaagatgtcaaaatcagaatcacggacagaaaagggtttatgatgcttatcctaatgccgctgatcctaacgtgtattttaggggcggcgctcggatcagttgttgacggaggcagccggattgatgacatcaaagtcggctacattcaatcagaccagtcagatgcagcgaacatgtttgcaaaagatgttctcaaaaaaatgaagtcgataaaggccacaaaagccggcagcgaagacaagatgaagaagctgattgatgaaaagaaaatcgaagtaggcatcgtcatcccgaaccattgggaagccggcaaaacctcagctgttgtttatgccgcacctgatcaaacattgaaaagttccatcatcgaaacagctgccagctcttttatagagcaatataaagcggtaaaggaagccgcgtcagcctcaatggactacatcagcaaaacggaagctgtaaagcaaggaaaacttgaccctgcacagtttgcagaaaagctggcaaagacgctagaaaaagaaacaggtgacaagctgactattgcggaaaaatctgtcggcagcaaagccgttaccagttttcaatactattcggcggcaatgctttgcatgtttatgctgtttcatatcacagtcggggcaaaatcgtttttacaggaaaaggatacggagacgcttgccagaatgctgatgacgcctgcgcaaaaatccgtcattctcttcggaaaatggcttgggacgtatctgtttgccatcatacaatttttcatatttctgatcgtcacaatcaatgcatttggtgtggactggggaggtaatttgctgtttgtgagtgtactcgggctttcttacgctgccgctgtatctggcatttcaatgctgcttgcgtcgtgcatcagcgatatgaaatctgcagatgcgataggcggcttcggtattcaattgcttgcggttctcggcggatccatgctgccgctgtatcaatttccggacgtcttgcagtccgtatccaaagcggtgccaaatcgctgggcgcttgacggctttctttctttaatggaaggaggaggctggtctgaccttcaaaagcctgtgcttctttttgcggcgatcggcctttgttcacttgtaattggtatcagacggcttcatacaagataaggagggtacaaaaggtgaaaaaaatcatagccatttgcggcattgagctttctctcatttttaagaagccgcagaactatttgatcatgtttgctgccccgcttttgcttacctttgtatttgggagtatgctcggcggcaatgatgataaggtgcggcttgcaatcgttgatcaggacgatacgattctctcacagcattatattcggcagctgaaggcacacgatgatatgtatacattcgaaaacgtgcctgaaaacaaagcgtcagaaaagctgaaacaaaagaaaattgccgggatcatcgtcatttctcgctcgttccagacacagctggaaaaaggcaaaaatcctgagctgattttccgtcacggccccgagctgtcggaagcgccgatggtcaaacaatatgcagaaagcacattggcaacgctcaatattcaggtgaccgcggcaaaaacggcatctcagacagcgggagagaactggaaggcggcgtataaaacggttttcgccaaaaaacatgaagatacagttccggctgtaacacgacagacgctcagtgataaaaaagagggtgtggaagcaagtgacacagcctccagagcagcagggttttccatcctgtttgtcatgctgaccatgatgggagcggctggaagcattttagaagcaagaaaaaacggcgtctggtccagattgcttacagcctctgtcagccgagccgaaatcggtgctgggtatgtgctttccttctttgttattggctgggttcaatttggcatattgcttctttccacccattggctgtttggcatcaactgggggaatccggctgcggttattgtattagtgtcactttttctattgaccgttgtcggcattggattgatgattgcggccaatgtcagaacgccagaacagcagcttgcgttcggcaacttgttcgtcattgcaacatgtatggttagcgggatgtattggccgatcgacattgaaccgaaatttatgcaatccatcgctgaatttcttccgcaaaagtgggcgatgagcgggctgacggagattatcgctaacggtgcccgcgtcacagatattctcgggatctgcggcatcttgcttgcttttgcggcaatcactttcgcagcggggcttaaggcgctccgagcctaaaaaacatctgcctaatggcagatgtttttttgcatgtgggtaaacccacgcattacgtatgaatgcagcctgaaggccgctcccggttaatccttatcgatcatagctaatatcgattccagccaagaaacgtaatttttctcccgctccagcgctttcgtcagcacgaggtagtggccgaagtccggtgaagaaaacgacatcggctctgctgaagccataagcttttcatagctttcctgcaggtcagacagcttggccttgcgttttagaagctggtctgtaaacaattctgaagcctcctgccgtgatagagaagaaataaagtatgccttcagcataaattcatccttcaccgtctccggtatcggatgatggcggatcagccagtcatgcagttcctgctttccgctgtctgtcagggtgtacatctttttctccagctttgtgccctgaatcgttgtccgaaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaaaataaaaggtttgtcagaaggtatccgatttatctccgtcaatgatataaaagagatttaaatttaattttcagaaaaaatattaactatattgattttttatgtataataggaaattggtggtatcagcattttaagggggaataaacgtgaaaaaagtacttatggcattcattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactgtacgcaattgatttttatgataaaacaggaaacaacctaaataacggcccgcagcttgcttcatatgttgaccgtgttttaaaagagacgggggcaaaaaaagtagatattgtggctcatagtatgggaggcgccaatacgctgtactatattaaatatttaggcgggggcaataagattcaaaatgtcgtaacgcttggaggggctaatggtttagtgtcatcaacggcgctgccgggtacagatcctaatcaaaagatcctctatacatctatttacagtctcaatgatcaaattgtcatcaatagcttgtctcggttacaaggagcgcgaaacatccagctttatggcatcggtcatattggcttgctctctaatagccaagtgaacggctatatcaaagaagggctgaatggcggaggcctcaatacaaattaatatcttcataaaaaacctgcagtctccgttacggcaggttttttgcatttttctagcaatctcgtctgagaaagatacaccaataaggcagaggggtttatgaccttagtctatcatgcatacgtcaatttatgacatcaggcactttttcaaatagagcggacatgttaaggtacaaccatcgatttctatcaatttgaaataaaaggagcggtgttatgcaaattaaagaaatttttatgatccgctgcatttcgtgcttaagtgtcgtcttgctccatatcatttcaatggtactgatgcttcaggcagaagctcttgcagatatttctcacactgttgattctttccgaacactcctgatgttcagcacgcccgcttttattttcatctctgaatttttactggcccgttcttatcctgatggggtgcctgacggttttttaaagaagcggggaaaagtgatttttgttccttttttatttatcgcggccatcgatgcgctgctgatgaccagtgcgatgggggagaggtaacctttctcgcgtttgtgcaaaaatatctggcgaacgtattcttaggaaactttatcggatacttcattctcgtcatctttcaattttacatgctgcatatgatgtttcatgagtatttgaaaaaagcatcgccgaaatgggtgctgtttatctcatttgtggtgacagccgcttatttaggctatttctccgcagccagcccggctcctgcttctgaagagggcggggcatttccgttcttctgggttccgttcgcaggctggcttttctacttttgtctagcctactattgcggaaaagaatacaagcgttttttagcgctgctgaaccaataccgctgggtcgtatacggttgcgcaattgcttctggggcgctggttgtcactgtttcttatgtgggtgaaatcggcatgatcagctcgaagcggcctgatatcatgctgtattcaacaagcatgattttcctgtgttttcacttgttttccaaaatgaagcatgtgccgaaaatcatgatgtttatcagcaactattccttttcgatttatctgcttcatgcctattttatgattataggctacgtgttgcttttgaatatgcccgaaattcccgccgtaccggctgttctcctgctgtttgccgtgtgcacagccggcccgattctgacctcgtgggcactgaataaattcaaatacgggtatttatttgtggggaaaatttatcagccaaaacagaagaaggtaacagtcgaagtgcgtgatcacgcagggtgaaaaacaagcggcaggagggctcctgccgcttgttgtgtattaaatcatacagtatacacaatctttttcttgtaaaataaaggagaagagtgaatagaagggagaacattcatgacatcagtcaatctaagctacccaataggagaatacaaggcgagggaatccatatcgaaggagcaaaaagataaatggattcaagtacttgaagaagtgccggcaaaattgaagcaagctgtagagggcatgacggacagccagcttgacacaccgtaccgggacggtggatggaccgttcggcaagttattcatcatctggctgacagtcatatgaacagctatattcgttttaaattgagcttgacggaagagacaccggctatccgtccgtatgatgaaaaagcatggtcggagctaaaagactcgaaaacggcagatccgagcggctcactcgcgcttttgcaggagcttcacggaagatggacggctctgctccgcactctgacggatcagcaatttaagcgcggattttatcaccctgatacaaaggagatcattaccctggagaacgcgctcggcctgtatgtctggcactcacatcaccatatcgctcatattacggagctttccagacggatggggtggtcttaacgcttttgccggtggaaagccggaatactgatagcagcaatcaccagaagtgagatcacagcagccgctgcatataactgatcatagccgctggcgacactcgcatgaatggcgtcgcttatcgcggttttgacttcaggaacgggaatgcgttcgatttgttcttgtaaagaagaaacatcagaactgtcgatctccggaatcatctgcatcgccttttctgaatatccgctgtccgataagcggctgttgatctcatcacctatttggtcaaacccggctgtgataaaacctgcataaagagtaggcgccaaggtcagtccaatttgccttactaatgaaagcgtgccaagagctgtacccttatttgtttttgccgcttctgatacaaggacgttcagcggagcgcctaacagaaagccaaaaccgatcccagctgccacacttgcgatcataaactcccatttttccgtcacccagaacggaaataaagcaaaccccgcacatgagatgattcccgaaagaataacggtttttacaggaccttttttgtcggtaagcgctccgccaagccaagcgccgattccggaagccaacgcaagcggtgtcatccaatagcctgcttttgcggcagggacacccaaatactgctcgacatatgacgggataaaaatgactgccgccaagagccccccggataataaaccaatgataagcgtgcgctgaaacatatggtttcgcagcagagaatacgccaaaatgggatcgcctcctcgcatttcaactctcttttcatacgagataagcgctgcaaaacagagtaggccaaaaataatacatccataaacctccggattccccaagctgtgtaagagatttgccccgtcaaggttcgtcatgccgtacatcacggctaaaatcgacagggatagaaggaagattccggccgcgtcgaggcgcttagcttcaggtgcttttgtttccgcgataaagtatgagccgaaaacaaccaatagcacggcaatcggcaaattaatcaaaaacagccaatgccaagacccggtccaatcaagcagaaagcttccgatatttggcccgagcacagcggccatcccgttcattgcgccaagcagcccaagcgccttcccctgtttttcctttggaagggtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccgagcgtataaagggtaatgccccatgatccccaggaaggggaaacggcaaacgactcgtttatcgttgttaaggcagctgaaataattccgttatctagcgcagccataaatacaccaaccgtaaacaggctgatcgcccacttttggcctttctgctctgttaatgcttcagacatattcatcaacccctttttttattcactcaaagtatattattcattttaaatgaactaaatgtcaaataaaaaaagcctgctcccgcagtttgcggatgacagacttacagatttattcttttttcgctttctctaatgctcttgaaaggatagacagcccttcggaaaccgcctgcttttcttcaggggacagcagctctaatgaacgcttcaatttcaggtggcctttttcatataaaccccggaaaatctttttcgcattttctgtcaactgaacaactacagagcggcggtcctcttcagaatgtgagcgtttgacaaaccctgatttctcaaggcggtcaagcagcccagttgtattggacagggaagcccccattttttcagcaatgtcgctcactttcaatgttccatggttgtttaatagcatcaacaccttcatttgcggcatgctcatatccagcttcatccactcggacacatcaccgaggccggcggaagttaagactttcatatagagcacccatatttcccgttcctccgatgaaagaatgttttcgtttaatactgttgtatcgtgtaaattatattccatttcatcacttcctcatcattcactcctcttaccatattactcgattttcactcctgaaagaaagtgagcagaaaccgcatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtcattcaaacgtacgctcatggtcatcaacggactggaacgaacggacttattcatgcttgtgttgatcggcttgctggctgttgcggctatgtcgctgtatgattacgtcctgaaatactcactgcgcctatcgatcacaaacggaaaagtattcagggtttcctggatcgccaactcatttaataatgtgctgggattcggcggtttagccggagtcgggttaagaatgatgttctataaggagcatacgaaagaccataaggcactcgtgaaaggaatcgcctggctcacatcatctatgctgctcggattatctgttttcagcattttcgtcgctgcgagagtgctgccagtggatgaagtgattcatgagaagccttggctgtgggcggtcgttatcggttttgcgctgatattgccgttatctttagcggtgtccaaaataaaagggcgcaaagctggggacgaagagaatgcggacaaagtgaaaaatccgattttcgcgtatattggagcttcagttgttgaatggctcatggccgggatcgtcatttattttgctttgttcgctatgggcattcatgcagatatcaggtatgtgttcggggtgttcgtcattgcggcgatcggaggaatgatcagcctcgtgccgggcggcttcggctcgtttgaccttttatttttgctggggatggagcagcttggctatcatcaggaggccatcgttacttctattgtgttgtacaggctcgcctattcatttatcccattcatcttaggcctgttctttgccgcaggcgacctgacggaaaatacaatgaagaggctcgaaacgaacccgcgcatcgcaccggcaattgagacgacaaacgttctgcttgttgttcagcgtgcggtattagtgagaattttgcaaggctcgctttcccttattgtgttcgtagcaggtctgattgtcctggcctcagtttccttgccgattgacaggctgacggttataccgcacattccgcgcccggcgcttttgctgttcaacggcctgtccttaagctcagcgctcattctgctgattttgccgatcgagctttataaacggacaaaacgttcctatacgatggccattacagcgcttgtcggcggctttgtgttcagctttttaaaagggcttaacatcagcgcgatatttgtactgccgatgattatcgtattgcttgtgctattgaaaaaacaatttgttcgcgaacaggcatcctatacactgggacaattgatattcgctgtggcgctgtttactgtggcgctctttaactacaatctgatcgcgggctttatttgggaccggatgaagaaggtgctgcgtcacgagtatttcgtccacagcacctcgcatattacacatgcaaccatcatggcgatcatcattgtgccgctgttcttcttgatatttacagtggtctatcataagagaacgaaaccgatcggagagaaagctgaccctgagcgtcttactgcgtttctcaatgaaaaaggcggcaacgcgctgagccatcttggttttcttggagataagcggttttatttttctagtgatgggaatgcactgcttctgtttggaaaaatcgccagaaggctggtcgtgctcggcgatccgtctggccaaagagaatcattcccgctcgtgctggaagaatttctgaacgaagcgcatcagaagggattcagtgttttgttctatcaaattgaacgagaggacatggcgctgtatcacgattttggctacaacttctttaaattgggcgaggaagcatatgtagatttaaatacatttaccttgagtgggaagaaaaaagccggccttcgggcaatcaataaccgctttgagcgggaggagtatactttccatgtggatcatcccccattttctgatgcgtttttggaggagctgaagcaaatctcagacgaatggctcggctcgaaaaaagagaagggattctcgctcggattttttgatccttcctatttacagaaagcgccgatcgcctatatgaaaaatgcagaaggagagatcgttgcattcgcaaatgtcatgccgatgtaccaggaaggagagatatcggtcgatctgatgcgctatcgcggcgacgctccaaatggcattatggacgcattgtttatccgtatgtttttatgggcaaaggaagagggctgcacgtcatttaatatggggatggcacccttggccaatgtcggcactgcctttacatccttctggtccgaaaggtttgccgctgtcatttttaataatgtcagatacatgtacagcttcagcggcctaagagcctttaaagaaaaatacaaaccggagtggcgagggaaatacttggcgtatcggaaaaacagatctctttctgtcaccatgttcctcgttacacgtctaattggcaaaagcaaaaaagactccgtctaataagacggagtctttttttatttcgtttttaagaagtaggtttcaatatcatcaagcagatagtttgcggctttaattccgcctgcggttgtccacacgacgtcatcgacttcatgtgcattacctgacttcacggccttcaggtttttccatagtgaactgcttgtccactgattggcccatttttcattttcctttgcattatcggctttataagtgaaataaaacagcacatcagcatccatatcaggaatggattctttactgtcggttgagaacgtaaattggtccttttgtttcttgaacagttctacttgtttttcagggcgtttgaagccaagctggtctaaaataatcccaggaaatgaatcggtataatagattcttgattcaccggataaaaagcgtacgacagaaacggttttgtttgtctggtcgcccagcttgttttttaaatcagaaacgcgtttatcaaaatcggcaatgacttccttgcctttgtcagccttattcaccgcgttggcgtatagagtcaggttatccttccagttcccagccaaagattcagcgaaaacagtcggcgcaatcgcatttaactgatcataaattttttcttggcgcactttgtttccaataatcaaatcaggctttaattctgcgatggcttccacattcggttccgtttcaagaccgacgtttttaacgcctttcatgtcatctttcagatagtcataccacgggtcgcccttccatgactttacggctccgaccggcttaatgccaagcgctaagagcgcctctgttccttcattagttaaaacaacaatccgttttggattggcgggaatgttgtctgatgtccccattgcatgtttgaccgttctagttttgctgcttgacccctcactgttacttgaactttctgaactattacaggcagaaagtactataacggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaattagatcatgatctgcaaaaaggcatcttcaaaatggattgtgttagtatgtctgattttcattttactggcggctgtctgcgcaagcgtcgtgtacggctatacaggtacgtcatggagacaggtctatcaggcgtttacttccttcaacggaacaaatgagcatgtcatcatcaaggatgtcaggcttccgcgcgctttggttgccacagttgtcggcgcctcgcttgcagccgcgggcgctctcatgcaggcgctcacaaaaaatccgcttgcgtcaccgggcattttcgggattaacgccggtgcaggtttttttattgttgccggatcgttttttctgcatattcagtcacctcaggcattagtatggagctcgtttctgggggcagcatttaccgccgcgatcgtctatgcagcaggctcgcttgggagggaagggctgacgccaatcaaactgacgctggcgggagctgccatggcggctatgttttcttctctgacacagggcttgctttctgttaatgaactcgagcttgcccaggtgcttttttggctgaccggctctgtgcagggccggagtctggatctgctgatgacgatgtttccatatgcagcggcagcgctggtaatctgcttctttctcggccaaaaaattaacctcctcgttatgggagaagatgtggcaaaaggacttggccaaaaaacaggcctgttgaaatttgtgatggcgctttgtgttgtcatgcttgcagggtccgctgtcgccattgccgggccgatttcttttatcggcatcattattccgcattttgcccgctttgtcgttggtaatgattatcgctgggttctgccattttccgctgttttaggtgccattttgcttgtttgtgcggatatcggtgcgcgatatatcattatgcctcaggaagttcctgtcggggtcatgaccgccatcatcggaatgcctgtgtttgtgtacatcgcaagaaggggggcgaagctatgaaacttcgttttggcgttactgcggctgaaaagaaagcatggatcgtatttttggttttactggggttaacagctgctgtactcatcataagcgctggtctcggacaaaggtttattcctccctgggatgtagcaaaaacattctttggtgcagattccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccggcagccgcatttatcggcgcatcggctgtcggactcatcgtctatttactggcatacaaaaatggtgcctccacatttcggctggtgcttatcggaatcggattttcaatgtcggcgcaggcgatgactaccctgctaatgatcaaaggtccgatttaccgggcatcacaagccaatgtgtatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggttcaggaagcgctgtgcagcgaaatcgttttttcttgctccttttgagtacggctcttacgggttgtgcagtttcagttgccggcacaatcggttttgtcgggctgatggcgccccatattgcaagacggcttgtcggctcatcttatggcgcgctgctcccaacgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttgatcgttacacccattttcttaaaaaagaaaatgggtttttttgataatgactgaaggttcgtaattatttttgctatactgacagagacattgataaagaaagggcggcagatgaatgaaagaagcagaggtattaaaatatgaagcatttacaagcagtcccggcaaaggaaaccccgcaggcgtcgttttgcagggagacgattatacggaagacgagatgcagatcatagctgaacgtgccgggtattcagaaacctcctttatccgaaaaagcgagtcggccgatcttgaactccgttactttacccctggacacgaaatgaatttgtgcggtcatgcgacagttgcttctctttacgcattatgtgagaaaggaatgctggagagcggtaaaacgtacagcatccaaacgaaagcgggtatcctgcctgtgaagatttctgaaaaagatggccgtattcatatcacgcttgaacaggcctctccgcaattcaaaccatttacaggcgatcggaaaaaacttgcggacgcactgggtatcaccgatgaagattttcatgaagaccttccgattgtgtttggcagcactgggatatggacagccatcgttccgcttaaatcattggaggcttccaaaaaaatggtaccagataacaaacaatttccggaagtgttagttgatctgccaaaagcttcagtccatccgtttacctttgaaaccgtccatcccgacagcgacctgcacgggcgccacttttcatccccatattcgggaacgattgaagaccccgtgaccggcacagcatccggcgtgatgggggcttatatgaaacattatggcaataccgagcagcataaatttatcattgaacaagggcaggaaattggaaaagacggaaaagtggagatcgaaatgaacgaagccggcggccatgtgaaagtgaacatgacaggaacagccgtttactcagaaacccgtattcttaaaatctaatacggatgatggtttacaaaaagatgcactttccgttatcattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagacaggtaaagcgaacctcattaatacatttgcagcgttctctaagaaatccaagccggatatgacagaggaaaagcttcaaaatttcaaaaacacacttgggcgcgttccgggatttctcctcgtcgtgtttcaggaagatgaaaacgacagagcgcgggacgacgattttgcggcaacaagctcgttgattcaaaaccttcagcttctcgcttgggaaaaaggaatcggcatggtttggaaaagcggaaaaatcctttatgacaaagaagtccatcaggcctttggtttgcaggataatgagcgtttcgccgctatcatacaaacgggttatcctgacgaggcgccggaagtgaaaaaacgcacaccgatccgcgaccgattcactgaaatgtaaaaaaccccttgtctcaaacggagacaaggggtttttcattaacgagatttctttttcgctctgttgtcggctgctttcgcacgctcttgcgcttcgcggtcatctgcatcagcaagctcggttgaatattcttcgtaaacgccgtcagtttccctttttaatgcatcgggaacttgtggaagcttttgtttgtttttatcacggtttttgtggatatgatttctgcccatatcaaattccccctaaaaagtgatatcaaacaaatatagtatttggttttaaggggctatgtattcctacttccgcttagcagctttttccgcttttttaaattcgcctgaataaagaacttcctgcattttcttcaggttggcgccttgctggtgcttctccctctttttttccataaaaaggacctccttcaaccatgttattcttaaggttgacgcttcctgctgtttttatacagtctttcggtccgctatcagctgtgagagtgcaaattcaagatccgaatatgtaaaacgaaatccagaggttatcgcttttttaggaagagcgcgctgtcctttcacaatcaaaagactcatttcacccaatgcttttgataaaaagaaatccgggacggggagccagtgcgggcggtgcttcacccgtgcaatcgcttttccgaattgcttcatgtccacaggattgggcgcggtgacattcattgggcctgagatgccggcattttccaccgcatatcggatcatctgggccgcatcctcgacatgaatccatgacagccactgccttcccgttccgatcgttccgccggccagaaacttataggggagaaccataagcggtagagcacctctttctccaagcatcacgccaaatcttgcataaaccgtccggatgcccatcgcttcaatattctgtccttccttttcccacaggtgtgcagtatggctgagaaaatcctcatctgacgttgcagaatcttctgtgaaagttttctcaaggcttgtcccgtaaatacccacggcactggcttggatcaatgtcttcggcttctccttctgtttctgaataagccgctgcacttcacgcgtcgcattgatacggctggagagaatgtgctgcttcgttttttctgtccagcggccaaaaatcgattttcccgcaaggtttatccagacatcaatatgaggaagttcctgctccggggcggctccttccgtcagccattgcacatatgtcatatttttttgttcagtttctcttgcgtttcttgataaaatataaacatggtgtccctggcggataagaacgcctgtcagatgctggccgagaaaaccggttccgcccgtcattgcgatattcatgaacatctctcctcatcgttctaataaatatactttacctcattgtaataaaagaaaacgcgtttcaggcctgagaagggagattaagatgccgtttattacaaaaatatcaacgcaaaaaaagaatacggaacgcttcaatatttttctggatgataaatacgccttcagcgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggaccacttaaagaaaaaagaaacctcgccccccgtcattgcggaagtcatccataggcttaacgattacaagtacttaaacgaccaggaatttgcctcagcctatgtcagcactcacaaaaaaacaaacggaaaaggccctgatgttttgttcagagagctaagagcgaagggaattgatgacgatacaattaaggaggtgctaagttccttttcctttgaagatcagacaagagaagcggtcaagcatgttgaaaagcttctcaaaaaagataaaaagctttcgacgaaagaactcaaacagcgcgcccagctgcagcttcagcgcaagggcttctcatttgatgttatcagcgcggcgatggatcagattgaatatgaaaatgatgaagacacagagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacacctcacgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcatggggatacaggacctcttcccctcagcaagaggaagcgctgccaatctcagtattgcaagaaaaagaataaagcgtaacaggaggctgatgatcagcctctttttgtttgcagcacatttacacgaattcttaaagaaaaaatcattgaattcacttgaaaaatcttttaagatgaaactcgttgttttttaaaatcaaaggaggcgatgacgttgagtatcaaaaacccatctgtaaaatttattatatttgttcttatgatttgtacattttcaatcggctatacagaatacgcggtgatgggtattttgacgtcgattgccaatgactttcatatacaggtttcatccgcagggcttcttgtcacggcttatgcggcaagcgtttgtttgacagggccgctcgtcaccatcatttccgtcaagcttccgagaaagcctgtgcttcttgggctgatggcgatatttatcctttccaacctgatgagcgcactggcgccgaattttgcggtattggccatttcaagaattttatctgcgtccattcacggcgctttcttcgcgattgccatggtattcgcaagtgaaatggttccgccggaaaagcgtgctgcagctgctgcttcaatgaacggcggactgacagtggctctaatgcttggtgttccattcggctcttatctcggagatgtcctgaattggagagcggtgttttccatcattacggcacttggtgtcatcggatttttaggccttatggctgccgtgccgaacagaaaaccaaaagtgatcccaatgcttatgaatgagtggggggtttttaaacacaaacaagtgctgttttccttcgcgattaccattttaggctattccggtgtctttatcgcctacacctttatcgaacccattttgaggcattcagccggattcagcacggttggcattacaggtgctctctttgcgtatggattgggaggcgttgccgggaatttctttgctggaaaggtaccgctgcctttgctgactcggacgatgatcggcgtaatgatcggtttaatcggtgttctggctgtatttccttacattgccatttacccggctgcagccattgtggcaacgttcctattcggggcatgcgcattcggcacgccgcctcttctgcaaacaaaggtcatttcctcatctgagggcggcacaaccattgccgcagctgtcagcgtatcagcatttaaccttgccaatgcccttggtgcatggatcggcggaatgattttaaacggaacaggctcttattcctggctgtttgcaggaggtgcgcttatgaccgcatgcggacttgtgctttctaccttcgcacacttatcagaaaagaagagcgtctacgaatatcaagtcaataaagggtaaaaacagctgcagtgtatgcagctgttcttctttaccgtttgcctgaggctctcattctttcttgaggatgctgattgatagatccgtcagcacgctttgaagcataatcgtcctttgctctcggttcaccctgaaatttgttttcgttttcgtaaggaaatcctttttctttatttcggaccatgtcatatccccctagattcgagatcaaaaagttgcgtctttccagatgaagacgtaaggttagtatatggagaacactacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctatgcaaaagccggacacgcctatcaaggtgaaaaaatgactgaaaaaatcgtcacacaatggattgaaaactatggcggccagctccacctttttcaaagctcccgtaacgacgtgaatgattacttaaatcaaagcagaggccttttgcattaaaaacctgccgttaacgaccggcaggttttttcattttcttaaaattaccttaacaggaagaaatcataaacaaaacatgtttcaccagcctgtcaatcagggaataccacttatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgatacttacatcataaaagcaggaaaactgaatgtccggactgagccaaatcatgaaggtgatattctcggcactgtatcatcagaacaaaaggtaaaagtcgataggttcgtaaatgccgattgggctcaaatttatttcaaaggaaagaaagcatatatttcaactcactttttaatgaaaaccgcaagccaagcgaaaacaatgaaacagacagccttctatgcaccgacgcccgaaaatggaaaagctaaacagctctcatctggaacagaggtgacaatacttgggtggggattcagtgaaaacggcggatttgacttcacttgggcgttcgtggattatggcggagttaaaggctatattcacacaaaggatttacaaatgcgataaaaaggcaggccgaggcttgtctttttgcctatgcatgaaacatttcttctttctgcacgtaacaatgagaaaggagatgatgatatgacgggtttagtcggcggagggcttatgatcattgcgggcatactgatcaaactgtttcctcccaaatcgatcaacagtgtgtacgggtacagaacgagacgctcaatgtcagatcaaagattatggaatgaagcgaaccgttacagtgcatcattaatgatcctgtcaggcttggtgattgcgggaatgggtttgctgctgggatcaaacttgtttattcttcagcttatcctgctgattgccgcctgtgtcataacatttatgctgacggagaaaaggctgaaaatcatgacgcacagtcaaggaggagatagaagtggacggagttaaatgccagtttgtcaatacgaacggaatcacgcttcacgttgcagccgcaggacgggaagatggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcgtatcggattgatacattaagagatgatatcatcgggcttattacgcaattcactgatgaaaaagcaattgtcatcgggcatgactggggaggggctgttgcatggcatttggcttccacacgcccggaatatcttgaaaaactgatcgcgatcaatattccgcacccgcacgtcatgaaaaccgtaacgccgctttatccgccgcaatggctgaaaagctcgtatatcgcatacttccagctccccgatataccggaggcatcactaagggaaaatgattatgaaacattagacaaagcgattggattatccgaccgtcccgcgctttttacatccgaggatgtcagcaggtacaaagaagcgtggaaacagccgggcgcgctgacagctatgctgaactggtacagagccctcagaaaaggaagcttggcagagaaaccctcttacgaaacagtaccttaccgaatgatctggggaatggaagaccgctttttgagcagaaagcttgcgaaagagacggaaaggcattgctcgaatggacatctcatctttgttgatgaagcttcccattggattaaccacgaaaagccagccatcgtcaatcagctgattttggaatatcttaagaaccaataagctaaaatttctctccatccgtctgtcataatggcagactttttctgtgcgttttttttcatagtctgttttaaacatgacaaaataacattaaaaatcatgaatgtcaccataaaattgtaacaaaaaacaggtttaaacgactttaaaaaaaggaatagccttactgaagatttgtgtaaaactcccctaaggcaatacttaaaaagaataataaaaagaaggtgccttaatgaagcaaggattaatctcgattattatcccgtcttacaatgaagggtataatgttaaactcattcatgaatctttaaaaaaggaatttaaaaacattcattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgagcatgttcagggcgaggcggttattgtcatggatgccgatctgcagcatccgacatatttgctaaaggaatttatcaaaggctacgaagaagggtatgaccaagtcattgcccaaaggaacagaaaaggggacagctttgtccgctcactcttatcatctatgtattacaagttcattaataaagcggtggaagtcgatttgcgtgacggtgtcggtgacttcagattgttaagccgccaagctgtgaatgcacttttgaagctgagcgaaggaaaccgcttctcaaaaggccttttttgctggattggctttgatcagaaaattgtattttatgaaaatgtcgaacgaaaaaacggcacctccaaatggtcgttcagcagtctgtttaactacggaatggacggcgtcgtttcatttaaccataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagccttggaattataggggaatatatcggccgaatctattatgaaacaaaaaaacgcccgcattatttgatcaaagaagcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaatttatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttctgcgtcttttctttttcttgctgtgtccgccgctgtttggctgcttcaagccgtccagctgatcggagaagcggatacgcttttttgggcagagtcagctgtttttatcagtattttcaaattgagcttgattatctttacgtccgcttctgtttttcattatcttctcaagcacagggcggcatcgttcacgggagctgtgttatacggcgtctcaattatttatttccgtcacgaagcgtattgggaatttttcaccgatacaatggtttggcttccgctgcttgtgcttggcgcagaaaaaattattagagagcggcgtccggcgtggtttatcgttgcgtgttcgctgacgttaatcaataatttttactttgcatacataaaccttatattcatcggaatctatgtgctgttcagatggctgatccgattggaaccacatgaagagaaaagatggattcaaatcagattatttctggtttcaggcttcatttcttttggcatcagtgcggcggcgtttgtgccggtggtatacggttttttaaacaacctgcgccctccatacagccagaaaatagagtggctcaatttcgatgataatatcttattttcgagccggatcatcattgtgccggccgcttttctgctgtttttgtttattatttctttttacaaaaaccgtgtgtttcgtctctttgccggattgagcctgctgtttattctttttcatttcagtccgtatgcggcaagcgtctttaacggtttttccgccccgcaaaaccggtttgaatatgttctggcctttaccattgcgggagcagctgcggctggtttgtcacagctgtctgatttgaaacggaaagaactgctcccggccgcagctgtcgtcctgcttctttacttgtatcatatccaaaggtataagctcgatatatggaagcctgcgaatgaaagtattctattgctcttactcatgacaatcgcagccttgtttgctgcagcttttgcgaaaaaacgggcaaacatggctgtgtacggcataatcattctttcttcgctgtttgtcgccaactcctatcaaaaatacgcgctctcagaaggcggcgatttggacagtgtgacaaaagaatatcttacaagtgaggaatacagagggcgggaatcatctgagctcattagacgtttacagaaggaagacgatgatccgctcatgagaatcgactggatgaacggggtccgcaataatacgccaatcatttacgggtttaatggcttcagcgcgtattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaacaaacgaagccagcgtcccgtacggcttcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgctgaaaggaattatattaaaagatccatcaggaaaaacggagcagacaccaaaaccgtccaatttgatcaccaagtcggacatcaccgcaaaacaagcccagtatcaaaaggggctgctaaccgtaactggagaaaacggaggagagctgatcatcaccccgaaacagccatcatccgctccgggagactactatgtcagcttttatttgaaaagcaaagcaaaagacaaaggatttacgttaaaggtaaatgattatgtcacaacaaggaaatcgaacaaatcgatatataaaaccggagtaaataatataacggtaagagtgcctaaatcacgccatatctcaatcaatcttccgaaaggaacctatgagctgagaaacatagcgctctatgaagaaaattaccaaacgctgaaaaacgctgtaatgcaaaataaaacagagaaagcagacaaactgaattggaacaaaaatcgactgacctttgcctatcatctgtcaaaagaccagtacatcatgcttccgatcccatatgaaaaaggctgggagctgaagatcaatggaaaaacacagaagatcgaaaaagcggattatgcttttataggcttcaaggcgcaaaagggagacaatcacattgagctgacttactatccgccatacttcaaaatatcggcgatcatatctctcgtcagtctgctgcttgctgttttttatataagacgtaaaaagcccggctctatatagagccgagctttaattttttctgtagtttttcttcgctgaatatccatcccgtataggatgaacgaattgtgagatcatggccgatatgaacaattgcgacaaacggataatggcctttgctccgataacgcaggtcgataaatctcacctcataatgatctttaaacgtatccacttcccaccggtaaaccggagaaaaggacagaaacgccgcgatgttatcatcctgctttgccgcatgcattacatcggtttcaggaacaggcacccgattaaatgtatccagaatcacgacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctcagctgcatgatcaggcgcaccaagtaatagcctgccaatatgatatataagctgagaaacgtgatgccgggactcccgcctgcataccaaatcgcgatagctgctagatggctgataaaaataaacggatcaaacgtattaatcagcccgagcgcaacccattttttcgaaaacggacgaatggcttgtgttccataggcgttgaatatatcaacaaagacatgtagaacgactgccagcagtgtccacagccacaggtgcagaaaatcggcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattccccattttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccttataaggtatgggtatctgaagtgatgctgcagcaaacgagagtagagacagtgattccttactttctgcggtttgtggaacaattcccgacagtggaagcgctcgctgatgctgatgaagaaaaggtgctgaaagcatgggaagggctcggctattattcgcgagtcagaaacctgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcggttgacggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatttgcacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattccctaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtaacgaaagaagagctcgaacaatttgcgttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaataaggcataatttgctgaaaggcatgatgaaaataagcgagttcactgttcttccaatcttttttggaaaccatgttcaattcgctcatatcacgtccgacatacataacagaagacccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcttcaggagtactaagacctgtcatggaattagaagaaacacactgggactggacgatgaatattaatgcgaaagcattgcttttctgcgctcaggaagctgccaagctaatggagaagaacggaggcgggcatattgtcagcatcagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaaacacttcccgaatagagaagatctgcttgaggatgcgcgccaaaacacgccggcgggacgcatggtcgaaattaaagacatggttgatactgttgagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggacaacaaggtcaattcggcactgaattcgctagtgaaactgacgcacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttacggagatcgaaatgattaaaggaggaaatgtttatactttcatcaggctgaaggaggaaccgatgaccgaatttgaaaagctggtaagtgaacagatgaaaacgatggataagcttctcgatctccaatcagagctcgaccgctgcaaacaaattgaggcggaactccggcatttggaaagggatgcaaggctgcgtgggattcaggctgaaattgcggtaaaacggaaacaccttgccgatatacaggatatgtttcaaaagcagacagagcaggtcattcgttcttatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcgcccgagtttgtcgatatgtggtatgaacggtatctgcgctatacaaaataatggttacgtaaaaacctgttgcggggtacaacaggtttttcacatgggctcacacacatcatgagaaagagagagggggatcaacgtgggggttatgaaacgctatatgcaattcgtcaaaccttataagaagcaaattttcgttacagtgttaatcgggatcgtcaaattttccattccgcttgctctcccattgcttctgaagtacgtagttgacgacattattcaaggaggcggcacggccagtgacaaaaccacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagccttcgtttttacgcgaacacaagaacaggagaagtcatttcccgagtgattaatgatgtagaacaaacaaaggatttcgtcatcacagggctgatgaatatatggctcgatatgctgacgattttgattgtaatctctatcatgctcacactggacgttaaattaacgctgatttctatcgtattattcccattatacggaatatcagtgaagtatttttacggccgtttacgaaagctgacaagggagcgctcacaggctcttgctcaagtgcaggggcatttgcacgaacgcattcaaggcatgcctgtcatcagaagctttgcgatagaagatcatgaacaggctcaatttaatgagaaaaacggtcatttcttagataaagccatccgacacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctatgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaggatacctttttatttagtgaaacgattcgggaaaatatcgcgatcggcaagcctgatgccacacttgaagagataatcgaagccgccaaggctgcaaatgcccatgaatttatcatgagttttccagaaggatatgagacccgagtgggagaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacggcacaatcattgaaatcggaacccatgatgaactcatggactatgagagccagtacaagcatttatttaccattcaaaatttgaactaaaacatcaatcttatatccttttaacgaaggatataagatttttttgtgtataaaaaaacccggctgtttaaccgggttactcttctgtttctatttcgcagtctttcggatgatacgtttgaaaacttgtgataagtgtttccaaatgttcaagctgctcgcgatattccacggcgcttgccataatattgagcatgttgtaatcaataagctcctcatccgtattctgctgattttttaaaaatgactttgttaaaagctgcttatactggatgccttcttcaaccgcgtcatcatgcggcttgatttttccgacaaacctcatcaaaatccgttcgtgccagtaaagcaggtaatcaagttcttcagtcagtgtttcctgaaactcttccggcatatgatagatctcgttttccagacgatgcagcttcttcaatgtatcaagcgcccgatttgccgtaataatggcctgtctgaacaggacaagctttcttgatttcacataagtcgttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagctttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctgatcaataataatgagaaaagagcggtaaatcgacggctggatcgcaaatatcgctgcaattccagcgaaaatcggcgcgggaagcccgatccacgaagccaaataaagggcaagtgtaatcgcaatcccggttttgaaaatgcgggcaccaagtttcattggtttgtgcgtgcattcctttctatagtaaattgtgtgacgtagcaaatgggctaatccttaaaattcccggttagtttatttgctaaacaattaagtaatatacagggatcgatacaaatattcaagctatttttctagaaaaagaccaaaatcttacacgttgtttgattccataaaaaaaacaggagctcaaagctcctgttcaaggtatttgattctagttttttagatgtttaaatgcatcctcgaccgctgcaagcgtgtctttaatatcctgctctgtatgtgctgtggtaataaaccaagcttcatacttagaaggtgctaaattaattccgcgttccagcatcagcttaaaaaacgtagcgaatgtttctccgtcactccgttcagcctgctcgtaattttccactttctcatcagagaaatataccgtgagcgcaccttttaaccggttgaccgtaatggtgatgccgtgtgtttctgcgtgcttcaaaatgccttcctcaagcatagcgccaaggtgatcaagcttttcatacacgccttcctctttaagcacttccagacaagcgatgcctgataggatggaagcggggttccctgccattgttcctgcttgataagcaggccctagcggagctacctgctccatgatttcttgtttgccgccataggcgccaatcggaagtccgccgccgataattttcccgagtgctgttaaatctggtttcacctgtaagagatcctgcgcgccgccatacataaagcggaaagccgtaatgacttcatcgtaaataacgagagcgcctgcattatgtgtcaattcatttactttttctaagaagccctctttcggctcgacgataccgaagttgccgacaatcggttcaacgagaactgccgcgatttcactgccccatttatcaagagccgctttatagctatcgatatcattaaatggtactgtgatcacttcgtttgcaatgcttttcggtacaccggctgagtctggtgtgccgagagtagacgggccggagcctgcggcgacaagcacaaggtccgaatgcccgtgatagcagcccgcaaatttaatgatttttgtccggcctgtatatgcgcgagccacgcggatggtcgtcataacggcttctgtacccgaattgacgaatcttactttgtccatagcgggaatggcttctttgagcatctttgcaaatgtaacctcgtgttttgttggtgttccatacagtacacctttctctgccgcttttttaatcgcttctgtaatatgcgggtgggcatgtcctgtaataatcggaccgtacgccgctaaataatcgatgtatttgttgccgtccacatcccaaaaataagcgccgcttgctctctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatctggacaagaattggatacgcttaataaaaaacatccggaggtaacgtaatgactatagaaatcggacataaagcgcctgatcttgagttaaaaggtgatcatggggaaacagtaaaattatcggattataaaggaaagtacatcgtgctttatttttatccaaaggacatgacaccggggtgtacaactgaagcatgcgattttcgggacagtcacgaaagcttcgctgaactggatgccgtcattatcggcgtcagcccggacagccaggaaaaacacggaaaatttaaagagaagcataacctgccatttctgcttcttgttgatgacgagcatgagctggcggaagcatttgatgtgtggaagctgaagaaaaacttcggaaaagagtatatgggaatcgagcgttccacttttttaattgataaagaaggccggctcattaaagaatggagaaaagtaaaagtaaaggaccatgtagccgaagcgcttcaaaccctcaaagatatgtcggaaaagtaaatctctatgagcctatgcttacttttaccctgatatcaattgacaaattatcgtaggaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacagtatataacaatttgcgtgtgttccgggaatcaggtttggtaaaagagctcacatacggtgatgcttccagcagattcgattttgtgacatctgatcactatcacgcgatttgcgaaaactgcggtaaaattgtggacttccactacccgggccttgatgaagtggaacagctcgctgcccacgtcacgggcttcaaggtaagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttatcacagcctggacaaatgacgcgaaccgctttagtcgaaagcattccgatccaaaagtaaactaccgtgctgagaccgatggataaaagcccaagtatcataaacaaactagaaagcaaaactgactctttgaaaaagatcccgatgtacataatgataaacccaacgaaaaccaaacttaacgcaaatgttctgattttattaattttgctggagtatttcgccatgtccatccccctccgatttaactatagcacaaacccgatgggattttcttcatgttttcggttgaattggaatttacttatggagacttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtgattgtaaaggatgctgatgagccagtttttataaagcattatgaatttgatcatcaaacagcttctttgcatgtggtaacagattctcagattcaagaatggattttgcttggaacaaatagaagaatcatagattggattgtaaatggcagagtcttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccgatcaatttttagatgcctacaacgctgttgttcatgcgctgcatcatttagcacgtattgaagtaatcgacagaggattccatcccgaaaccacggtgtggagccaagtgcgccagatggagccgcaagtgtacaaattatattccgagctgattgaaagtcatgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacagaaaagggacttatcaacgtctgccagatagaaacgaaaggacaggctgtctatcaccgaggatattcttttaaaaaaggtgttgactctgattcttgaccgtgttatattattaaacgtcgctgatgcgcttctgagaaaacaagctcacagcggcggggaaataaatcaaaaaaacatttgacaaaagaaagtcaaaatgttatattaataaagtcgcttcaacaagaagtgaaaatgatctttgaaaactaaacaagacaaaacgtacctgttaattcagttttaaaaaaatcgcacagcgatgtgcgtagtcagtcaaactagggcctgcacgacgcaggtcacacaggtgtcgccgcaggatgcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactatgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctttacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaatgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaataagtttttttcaaaaaaacacttgattttctcaagaatacatagtataatgttaaatgtcactgaaattgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccactgatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattatatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttaaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttcaaaatttaatgtggaggggtagcgaagtggctaaacgcggcggactgtaaatccgctccctcagggttcggcagttcgaatctgcccccctccaccatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccattaaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacataagtagatcatttttttaatgctttgatttatcataacaagttaagttccgaggcctattataaagcggctgtatagctagtctttcaacacttttattttatatttccataaaaacttttttgaaatacgttgacactttatgagatccatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttattaaagaaaaggagcctcggctcctttttatacttactcagcgtattggtctaggatctcttctagcacctcttctagctcttctgtatcttcaagctctgattggctgaaacgtacgcgtacaagctgttctccgtcattatacatctcttccagccaccctcggagtcctcttgctctgcggtcgacttcgaaaatgatttccaaaccgtcttcgtctaaaaggaaaatgagctctaattcatcaagcatctgacgataatatccggaagtcggaacgaattcgaattcttgaacgaacggaagacgacgctggaagtagggcgcttgttcgcagtctgcttcgttaagatggaagcccaggttttcgattgcttcaagcacattttcaatccaagggtgcgcttcaacgaaaatgcggtcatgatcggatttatcgataccgccttgaatgtcaaggtctgtcaccacggcaacctctactttccctacagtgatcggcgtatctagaggcagagtgaatgtgaacggaaattgatgctcttcaccaggctgaatggtaaatgaaccagtgacccggaaagaatgaattgtagcgtatttccggtgctcttcatcgtcttttacaatgacataccgtgtactaagctgtaaatcgatataacggatgtcctgagcgatttttccgcctttgacatgtacagttccctgtacttcttctccaggaaaatatgcgtctttctctaaaatagtatcaacttttgctgctccaattccggcacttgccgcaagcttcttaaaaagtgacatgttagatcttcccctttttcttttttctcaacagatatacgtaagaaggaggaaaaaagattcattcgatccatacttttttcctattattcgtctcggcctagggacagactaagaataatattgaaaataaaggagtggatggaagtgaataaagaaagtttggttgcagatgaattacacagaatgtttttggctggtgagctgcaaatcacagtagaggaggatataaacaatatttccgaaaggctgagaaacggcgatctcagtttagaccgattaagcggtgaagacgcgtttataaaagaaacggtaaacgaggctttaagaagagtggagcaataaaaaagagacggtatctcatctttgagatcccgtctctttttgtgatctttgctgtaagataaaagcgtaattgctcaccagagccaccctttttccaacagaaaatctgacagttcatcttggagataaacagttgtatctaattgatcatgcaatgctcttctgatgtggggattttcggcttctgttattgcgacagtgtatttgttaatgctggtttttattgttgttaacaaatcaagaatatctttgggacaaagactttgttcaatgggaaaccacctcctttgtttttttagcagctcctgataagaaagtatttgactttgtttcttgcttctatacaaaatgctataataagcaacaaattttgttgggggtgtgatgatgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacactggattgtgtgccgtctcacttatctttgtttaagccgccatcaacagatgtagcttcttttgttatggaaatggacgtgatttatgttggcggtggaaatacgcggaatttacttgtgttatggaaagagtgggggctggatcatattctcagggaagcatggaagaacggtgtggttatagctggattaagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggtaagcttcttaaccctttggacctgatctggttcgtaccagcgtggggaagtagaggaattgtttttgttattgtcgtgctgggcaataatatgtttctttctgactgtaaccgggttcatttatatgaatccggttttttgtgctggttatgggcttgattttgtcctttcaaacgtagagaggggaaggaaagtaatgcaaaacaattcagtgcagcaagccaacatttccattatgtcaagtttttcaggcagcaagaaggtatacgtggagggttcttcttcggacatccaagtgccgatgagggagatcctattgagtccgacgacgggatcgttcggcgaagaggaaaacgcgcctgtgcgtgtctatgatacaagcggaccgtatacggaccctgaagtaaccattaatattcaagaaggattaaagccgctccgccaaaaatggatcacagagcgcggtgacgtggaagagtatgaaggtcgggctataaaaccagaagataacggttataaaaaagcaaatccaaacgtaagctacctaggattaaagcggaaaccgctgagggcgaaggcaggtcaaaatgtcactcaaatgcactatgcaaaaaaggggatcattacacctgagatggaatttatcgccattcgtgagcatgtgtctcctgaattcgtcagagacgaggtagccagcggccgggcgattattccttcaaacattaatcaccctgaaagtgagccaatgattatcggccggaattttcatgtgaagattaatgcgaatatcgggaattcagcggttacgtcatccattgaagaagaagtggaaaaaatgacgtgggccatccgctggggagcagatacaatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagagcagggagtggattattttacgattcacgcgggtgttttgcttaggtatgtaccgctgactgccaaacggacaactggtattgtgtcacgcggggagcgattatggcgcagtggtgtctggctcatcatcaagaaagctttttatacacacattttgaagaaatctgtgagattatgaaaacgtatgatattgctttctctcttggggatggtttgcgtcccggatcaattgctgatgccaatgacgaagcgcagtttgctgaattagagacgcttggagagctgacgcaaattgcctggaagcatgatgttcaggtgatgattgagggtcctggacatgttccgatgcataaaatcaaagagaacgtcgataaacaaatggacatttgtaaagaagcgcctttttacacattggggccgttgacaacggatattgccccgggatatgaccatattacttcagcgatcggagcggcgatgatcggttggtacgggacagcaatgctttgttatgtaacgccgaaggagcatttagggctgccaaaccgtgatgatgttcgtgaaggagtcattacatataagatcgctgcgcacgctgcggaccttgcaaaagggcatcccggagcgcaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgcgaagaaaaacgatctcagtgaagcagaagccataaataaaggattaaaagaaaaagcaaaagagtttgtcgatacgggaagcaatttatatcaatgaaaaagatgaagatggagaatgctccatcttcatttttttagaaaaacagagagcgtcgaagcggcggaatgctctgttcaaaacggaaaacattttctggatcatatttcgttttgacacggcggaggcgttctacgttttcgccgtaatatgttcttggccagtttctgatttcaatatctggccaatttacgtagtctcccatcgtttctctcgaaagggacgttctcagcccctcaatccagcggacgttttgtcttttttctccaggggatgtccagtttgttaagtattcctgggcaatgattgcgtcacgataataaaatgccgtttggtcgggagcgatccgtccggctgccccgccgagtgcttgctgccagacactggcgttttgattcggagcgtgctctaaaaagtgttttattgttgaaatcgcacgttctgataatggcttttcaatgaaagagccggagcgtttcattttttgaggctgattgcctcccgggctgttaaaaaaggttaccgcttcgatgaacggcattgtttttaccattccgcttgttgggcttcctgctttcaataaaggctttaacagtttttttaactctgtttttggcccgacaaattggccgagggcttctatgcggtttacttctttagggcaaaactctattgatgatgtaagccggtcatctgtatacggggcccagtgctgccacgtgttaaatacttcctcaaaatcatcccatccccatgttatagaaaaaatcgacacttgagagatgggcactgctttaaatgtcatggaggtgactatgccgaaattgcctcctccgcctccctgagacgcccaaaataagtctggatgatttgaacagctgactgtaatcagatcagcgccctctttttcgtctgctacgatcatcttaagctgcacgaggctgtcgcaagtaaggccggcagcccttgttaaaagtccaattccccctccgagagttaaacctgtgagccctacattagcaatggtgcctgcgggaagcgtcaggccgtattgccagagtgtccgatagacttctcccaattcagcccccgcttcaatataggccagctttttatcctgattcacagttatttttttcatctcgcttaaatcaataacaagaccgttatttaaaagggaaaagttctcatagctgtgtctgccgcctctaatacggaaaggcacacggttttcacgcgcccatttcagcgcattgagtgcatcctgtttgttttggcaaaacacaatgatgtcaggatacctttctaagcttaggttaatattggttcttgcttcgttatagtccggatcatcccgtgtcacgatacgtccggtcaattttgtcttttccacactcccacatctctttctctcgtattctagtttctctagcttatgcgtcaggggaaaagagtgtataaggaaaaagcggggatgcaatctgatacagtgtcaacaccctcaaaaaatagttgacaggtcggtattgtatgaattaacatggtcagtacaaatttttcaaattaatcgcgctgatcggaacaccgaaggctcttatcgtttagataagggccttttttgtatgaaaaaggagggattattgatgggagtcaaaaaagaaaaggggagaaaacgattcaggaagcgaaaaacctacgggaatcagattttgccgcttgagctgctgattgaaaaaaacaaacgagagattataaacagcgcggagctcatggaagaaatttatatgaagattgatgagaagcatacgcaatgtgtaactaaatataaaaaaacccgctgattacagcgggtttttgcatttctacattaagcatcttttttaatcggcaatccaaggccttctgccacgcgttttccgtattcaggatccgctttgtagaagtgctcgatttgacgaagcttgatttcttctttttctaccggcttcatagcattaacgatattttcaacaaggcgggtacgttcatcttcactcattaaacgatacagatcaccggcttgagtgtagtgatcgttgtgatcgtagcttacgctgtcagcgataccttgtaccggatatgctgcttgcttatcctcaggtgactcttttggaccgccgaagctgttaggctcgtaatacacagatccgccgccgttatcgtcaaaacgcatttgtccatcacgctgataattgtttactttgttgcgtgcgcggttgattggcagcgcttgatggtttgcaccgacacggtagcggtgtgcatcatgataagcaaacagtcggccttgaagcattttatccggtgaaacatcaataccaggcacgagtgttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacggtacgtgtttgcatcttctaaaggcatgatttgcacatatagtttccatgcaggataatcaccgttttcgattgcattgaaaaggtcttctgtatggtaatcagggttttcaccagcaatttttgctgccgtattgacatcaaggttttttacgccttgttccgttttaaagtgatatttaatccatacgccttcgccttcggcatttgtccatttgaatgtatggcttccgaagccgtgcatgtggcgaagtgttgcaggaattccgcggtcagacatcaggattgtcacttggtgaagtgactctggtgaaagtgaccagaaatcccatacagccgtagggtttttcaggtgtgtttttggatctcttttttgtgtatggatgaaatcagggaacttaatcgcatcgcggataaagaatacaggcgtattgttgccgacgatgtcgtagtttccttcttcagtataaaatttaacagcaaatccgcgcgggtcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtagatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatatctattaatcgatatctaatatcgaaagtgttgaaaaaccttgttgtaacagctttttatgacacttaataatttttggagaaataattttttcttctctatttgcgaaacaagcagagtaagtgataaacaaggatatcaaaaatcgtatttaaaaaagagttgacatatcggaataatttgaattaacatgttattcaaacaaaaaaacaattgggcagctgatcggaccgccgaaggctctcatctctacaagaacagagatgggggcctttttgttttttttgaaggcggggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgcggaaaaagcaccctgttaaagattattgcagggcttgattctgaatatgacgggagtgttgaaattaacggccgcagcgtaacagctccgggtattcagcaaggatttatttttcaggaacaccgcctctttccttggctgactgttgagcagaatattgccgccgacttgaatttgaaggacccaaaagtcaaacaaaaggtgaatgaactgatcgagattgtcagattgaaaggatcggaaaaagcatatccgcgcgagctgtcaggcggcatgtcacaaagagtagccatcgcccgggcccttctgcgggagcctgaggtgctgcttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagctagcgatccttaaggccaaaccggggaaaatccataagctgatgcccattcacctggcgtatccgcggaaccggacgactccggatttccaagcgatcagacagagagtgctgtcggaattcgagaaaacagaagatttggagtacgcagaaggatcagggatatagaaagggcggaagcggaaatgaaaaaagggctcattgtattggttgctgttatttttctgctcgcaggctgtggagcaaatggagccagcggtgaccacaaacaattgaaggaaattcgtattggtattcagcaaagcttaagcccgcttttgatcgcaaaagaaaaaggctggtttgaagatgcatttgaaaaagaaggcatcaaagtgaaatgggtggagtttcaaagcggtccgccccaatttgaaggccttgcggcagacaaacttgatttttctcaagtcggtaattcgcctgtgattgctggacaggcggcaggcattgactttaaagaaatcggtttgtctcaggacggtttgaaagcaaacggcatccttgtcaatcaaaacagcagcattcaagacgttaaggacttaaagggaaagaaaattgcagtcgccaaaggcagcagcgggtttgattttttgtataaagcgcttgatcaagtggggttgtcagctaacgatgtgacaattattcagcttcagcctgatgaagcagcttccgcattcgaaaacggatccgttgatgcctggtccatttgggagccgtacttgtccttagaaacaatgaaacacggagcaaaaatccttgtgaacggagaaagcacagatttatattcaccgggttttactttagtaagaacaaagttttcagaagagcatccagacgaagtggtccgttttctgaaggtgtttaataaagccgttgtatggcaaaaggaacatctggatgaagcagcggacttgtattctgacattaaagatctcgataaaaaggtcgtcgaaaatgtgctgaaaaatactgaacctctgaatgaggtcatcagtgacgacattgtgaaagcgcagcaggaaacagcagattttcaatttcgaacaaaggcgatagataagaagattgatgtgaaggatgttgtcgataacacttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctggatgaaggggcttttactgcccgctgtcatcattgccatctggcaggtcatcggcgggctgggggttgtgtccgctacagtgctgcctacacctgttacgattgttctgacctttaaggagcttattttgtccggcgaactgttcggccatctgcaaatcagcatttatcgggcggcacttggttttttgcttggcgcggggcttggattgatgatcgggattttggccggattctccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcatcagcagatatccaaagtgatattgccggcagccctgcccaatatattgctaggcattcgcttatcgctcggcattgcatggctcgggctcgttgtggcagagctgatgggctcaagctcgggagtcggctatatgatcatggatgcgagacagttttcacaaacgaataaagtctttgcagggattatcatttttgcagtggttggaaagctgacggattccttcgtcaggctgcttgaacgaaagctgttaaagtggagaaacagctacgaaggataaaagatataaaggggagatgaatatggaaattctttggtttataccgactcatggagacgcgagatatttaggatctgaaagtgatggacggactgcggatcatctttactttaaacaagtcgcgcaggcggcagacaggctgggatatacaggagttcttctgccgacgggaagatcgtgcgaggacccgtggcttacagcgtcggcgctggcaggagaaacaaaggacttaaagtttttagttgcggtaagacctggtttaatgcagccttctctggcagccagaatgacatcaaccctagaccgcatttcagacggccggctgctgatcaatgttgtggcagggggcgatccgtatgagctggcaggcgatggcctgtttatcagccatgatgagcgctatgaagcaacagacgaatttttaaccgtttggcggagacttttgcagggagaaacggtttcctatgaaggaaagcatataaaagtggaaaacagcaatctgcttttcccgccgcagcaagagccgcatccgcccatctatttcggtggttcgtcacaggctgggattgaagctgccgcaaagcatacagacgtatacttgacatggggtgagccgcctgaacaagtaaaagaaaagatagagagagtcaaaaagcaagcggcaaaagaagggagatccgttcgatttggtattaggctgcatgtcattgcccgtgaaactgaacaagaggcgtgggaagcggcagagcgcttgatcagccacttggatgatgacaccattgccaaagcgcaggcagctttgagccgttacgactcttcaggccagcagcggatggccgtccttcatcaaggcgatcggacgaaacttgaaatcagcccgaatctgtgggcggggatcggcctggtcagaggaggggcaggaacagctcttgtcggtgatccgcagacgattgccgaccggatagcggagtaccaggcactcggcatagaatcgtttatattctccggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaattaaaatacagcccccaaacatggtatgatattcaaaaaaagggggctttttttctgaaaacattgagaagcgcggcagtcatttgcctcatagctatgctgtcagcatgcggacattcaaaacagatggaaatcaaagcggcggacatatcagaacttgaaaaaaacagaatggatgttgcagcttcacaggcattcactgctgaagccgtcaatatcggtgaaggtatttcttcagctgacatgtacatcgaacattatcaaaagggaaagcttgttgagaggttaggaccggctagtgcagattattcagaggaaaaacccgataccatacaatttgtttattttgagaatgaagagggggcaggaaagaataaacataccaccattcattttggcattgtggataaacagggaactatagcggctgattcatcggtgaaacgtgacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagaatgggcggcttcaggccgtctgtttttcaaagcggtatgcttgcttttttgaatggtgcatgatacattttaaatcgtaataatttcgatttaaaagggaggctatgtgacttggctaaaaaatcaaaagtggcaaaagagttaaaacgccaacagcttgttgaacaatacgctgatattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaactccggccgattacagcgcgccggagtttttttcgtttttcttgaaagagatgacgtaggaaaggtgctggatgatcatgatgataaacacaataataatagggaaaaacggaatacgcgattgaaatagtggataaaaaatgagaagaaccgctgcggcaggcagcgagaagtagacagcgatatatgacgcgcgacatgcttttgccgtcatcatctgctctctttcatcctgctcttcaaactcatcaggcagaagaagctgctttctggcagggcggctttttttctgtaagtacaaataaaccgcaaacgccgcaacaaacagaataaagggggtgaggtttaattcaaataccatcccgccgctctttgtgccgaaaaaagatgctatgccttctgaggcttcaaagtatgaaatcagcgtccagcatgcaaggccaaataacacaaggtgaaaagctgcttttgttttcatgctcatcttagttttcctcctctaaccaaaagacatcctccattttcatggagaaggctttgcagattttcagtgctaacagcagtgagggaacataatcgcctttttcaatcgctgccacagtctgtcttgtgacgccgaccgtttctccgagtttttcctgagaatagccgaagcgtgccctcagctcttttactttatttttcatcatgacgtctgtccccttcacaatctcgattgattatattgtatagtatacttaacattatgtaaatgaaacttaacaactttacaaaaagacaactttttttcgacaaattttttatattcccttgacgaaaaataaataaacatgtaatataaaaaaagtcagagcggtactgttactgacaaccacaaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtaaaaaagaacacgacattcgtgttcttttacgtaagccaatgtactgtatgggtgccgccgtgaatttgttcaaacattttcgttaatgatgataagaggttaacagcgctgcttttctcaatagatggcgggaaaaaaatgatttgcagcatattcttagtctcgtttgaaacgggatagtggttgacgctgtttttgaaatcgccaaaaatgccgttttcatcagagaaaagcagtatgttttctttttctcccaatgagatccggaccggctcatgaagctttccggcatcataaatcataataggcagagaatattttaatgcgaaaaaatcgattgtgtcatgggccgagtctttactttccatgaattgttccttggatatcgggaccagcatgtcctccattggggttgtttctccctcaaatgaagggttaagctgtttaaagagtttctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccacacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgaccgctgatacttttgacagtttaaaagaccgtttgattcttcaagaatcactcggctatctctccggctttgaagagccggatatcgaaaaaagggtgacgccgaagcttcttttgccgaaagcgaaatcaatagtggcaattgctctcgcatatccttccagaatgaaggatgcgccgagaagcacgagaactgagcgcaggggcattttttgcagagcttcctggggaaaagactatcatgatgtgctgagggaaaagcttgatctgctggaggattttctaaaaagcaagcatgaggatatcagaacgaagtcaatggttgatacaggtgaattgtctgatcgcgccgttgcggaacgtgccggaatcggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgtttggacgcctgtccgacgggagcactggttaatcccgggcagcttaatgcgcagcgctgcatctcttttctgacccagacaaaaggatttttgcctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttggccatcagcaatcgggaatttaaggagaaattcgggcatgtctcaggttcttggcgcggaaaaaaaccgattcagcgaaacgccattctcgcgcttgcccattttaaggatgcttccgcactgcctgaattgacggaactgatgcacaaggatccgcgtcctgtcatcagggggacagccgcatgggcaatcggaaaaatcggagaccccgcatacgcggaagagcttgaaaaagcgctggaaaaagagaaggatgaagaggcaaagctggaaattgaaaaaggaattgatttgctaaaagcttcaggcatgactaaacaaggcctgtcctgacatacgtatagagcagaaggaaaaaacacttgagatcatccaagtgttttttctctataaaaaagtatggcgggtggggtgagcttgaagcacattttagaacaattagcggaggagcggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcacccgaacaggggatcaggctggtggatgaaacaaagctcatggagctacagctggacggtggctcactctatgaaaatgtatttgtcgaattcaaaggccggactgcgtgcggtgcgggtgaaatcagcggaagaactgatgccgggcgatgtgatttgctatgacttcgaaggagacggccggtttaatcatacaacgattgtcgtgacaaaggacaaaggcaatatgccgcttgtcaacgcccagacttatgacagcaggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaacggatgataaaatgctgaaacgtgccggactcgattattgggagtttgttaacgttgtgtatcatgattcgttagaagaattgtttgaggcatataaaaaaggcaagtttttctttattacaaaatttggccagcagcctcatacatcatttgattacactgatcttgacgaggattatttcttcgtgttcggaagagaaacaagcggtttgccaaaggatttaattcaaaataatatggaccgctgcctgcgtcttccgatgacagagcacgtcagatcgttaaatctgtccaatactgccgcgattcttgtttatgaagcgctgcgccagcaaaattaccgtgatttaaaatagtgaaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttctcatccagcgatttgctttcgctgtatgtgcttgagggactgctgcagtctggaaatgtcagccttgcagaagcaaaaatggctgcagaggtattaaagaagcatgatactgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcgatggatgtagtggaaaagctggtgataaacggatcaggaagttcaaagggaggaacatttcaatctgttgagattaatggcagcgggacagtggccggggacgtggagtgtgacactttttcttttaatggaaacggaaaagcggacggcagcgtcaaagcgaaagcggtaaccatcagcggttcaggaaagatacatggagacgttgaagcagaatctatccggatgaatggcactagttttatccaaggagaggtatctgcaaaacaattgaaaatcgctggatcatcaacatttggcggcactgtcaaggctgatggcattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgcgcgggagatcggctgccgccatcttcaagtgacctgcagaaaaggaatgctgacattgctcagattgatgccgcagcctgttctaacagcagagctgatcgaaggtgacgtgattgaattgacaaatacaaaggcgaaaaccgtgcgcggtaataaagtggtcatcggcccggattgccagattgaaactgtcgaatacagcggggactatacctgtgatccaagcgcatcggttgaaacatccacaaagttgtaaggaggatcgtaatggagacaacaaaactgggaaatttaaaattatatggcgctgggcatgccacaggaggcgcgtatcacaatgtcagcatcaaaggagaaggtgtagttggagaagggttgtctgctgtaggctgccgcatatacggaacgggcctttttcttggaaaagcagagactgagcggctgcgtgtgcttggagaaagtgaatgtaaaggcgatctgacagccggcaaaatcaatatatatgggacaatgaaagtcagcggctcacttcaatttgatcgattcaatctgaaaggccagactgaaattggcgggaatatgactggagaatcctgcgatgtgaaagggaagctcagcgtaaaaggtgattgtgaaacagaaatgttccatgtcacaggctgtgttgatgtatcggggttattaaattcgggtgagatcaagctgggattgagccatgatataagtcatgtacaggaaatcggcggaacaacaattacagtgaaaagacgcgcgagtttttttaaccggaagaaagtgaagctgttcgccgatgtcatagaaggagatcggatttatttggagaataccgaagcggcagttgtcaggggaaaagaagtgatcatcgggccgggatgcagtatcggaacaattgagtacgaaaacaaatatgaatgcgatccgcattcacagattaaagaaaaaacaaaactgtaaaacattgttctgttatacaaaaagggtgctctttcaggagcacccttttttattcttttccaggcttgctttcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcagtctgccttgtcaacgatgtataagtatctttatttttaagaaaccaaagcatgtatcacgagatggcggcatagattgtatcaaagtaccttatttgcatagtgtatcaaacatgatagaggaggtccttatggatatattaaagaaaattgaaaagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacggacgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacaatgcttaaaaaaggtctcgaagcatacacgctgacagataatggcgctgtatatgcaattaaaggctgcccgatgcacgaggaccctctacatttaatcccccatcatttacgcgatgacttttacagagaatacggcattagaatagaaggaagtctttctcctttaaatgtcatgaggctggaggaagagtacggaggaagaattgaggatgtgaaggtggagcgcatcttcttttcagaagataagcgtacgggaattggaacattcagtccctctgatccgaaatctcaggatatcgccgatttgacggggagtattgatttctcaacaatcgccgagtacggttcagaatcagatccgcgcgcttatcggtttgacggagagctgaataaagcgaaccgcgggatgatggagtttcaggagatgctgaaatgtgatgagaaatttctctggcatttgctttccttgacacaggaagggaattttaaagctgggcggtttgcgttaatttctgctgatgagctgatcgtggctcacacgaatgaaacggagtatcgctcatttatttctaataagaagaatgaagccctgcactcaagaatcatcgtgatgccggttccttataatttaaaagtgtctgaggaagagagaatttatgaaaaaatgattgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggagaaagtgtggaaggatataattctgtcgacgttgaggatatgaaaaaagaatataatgatgaaggcatgagcggcattgatccgcggtacgtgatcaaccggatttcttcaacgattatcagaaaaaatatggaatcgattaattctctcgatgtccttcgctccttaaaagaaggtcttgatcagcacccatcaatttcaagcgaggacagagagcggtatttgaattttatttctgccgcccgcaaggaatatgacgatattgcgaaaaaggaagttcaaaaagcgtttgtgtattcatatgaagaatcagcaaaaacacttatggacaattacctcgataacgtagaggcctattgcaataaaaacaagcttcgtgatcctttgacaggagaggaaatgaaccctgacgaaaagctgatgagatccatcgaagagcagatcggcatttcggaaaacgccaaaaaagcgttccgcgaagaaattttaatccgcatctcggcctatgcgagaaaaggcaagcggtttgattacaattcccatgaaagactgcgtgaagctattcagaaaaagctgtttgctgatctgaaggatgtcgttaaaattacgacctctacaaaaacgccggatgaacagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtcccattttctaaatagtttgtcaattaaacgtgcatatgtgcatatgatgaatataaatcttttcaaaagacttgtttcataatctggcacaagccggaatacgtatgtatcacgaccacaaatggttaaggaggggaattcatgtcccaaaatgacagcggccattttttgatttctgaggaaaactggtccctccatcgcaaaggcttcgatgaccagcagcgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgagacaatatcattcatacagatatcgagtttaatgatatccgtaaaacagggttaaccggtaatattgataagaaaagaacgatgatgtcagcctttaaacgaaacgcaatgtcaggaaaaccgtcgttctatccaatttatccggaggacctgaaatataagacgtggaatgacatcacaaagcccgaatcaaaagccgtcgttttagccatgatggatacaagcggcagtatgggggtttgggaaaaatacatggccagaagcttctttttctggatgacccgttttttgcggacaaaatacgagactgtggaaattgaatttattgcccatcatacagaagcaagagtggtctcggaggaggattttttctcaaagggagaaagcggcggaacaatttgttcttccgtatatcggaagtcgcttgagcttattgatgaaaagtacaatcccgcccgctataacatttacccgtttcatttttctgacggtgacaacctgacatctgataacgcgcgctgtgtgaagctggtcaatgatattatgaagaaggccaatctgttttgctacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggcttttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgctggcttgtaccaaaagcttgatacctcccagctgcagtatttgcgcaaactagccggaagcttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcagcaggtaaagtatctgactgggatctggacgaaggaaaaacagtgaaaaaaggcgacacagttgcaaaaatcaaaggcgaacaaactgttgacgtaaaatccattatggatggaacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgtagtagttgacggagaccctgatactacatttgacggtactgtagaagaaattggttatgcgactaactcaacttttgatatgcttccttctacaaattcaagcggaaactacacaaaagtaacacaaaaagttcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatgcaaaaaaccctatgtcattgctgattgtgctaatggcgggtttatttttggcaattctaaaccaaacactgcttaatgttgcaatgccgcacttaatgactgaatttggcgtaagtgcaacgacgattcagtggctgacaacaggttacatgcttgttaacggtgtattgattccgttatctgctttcctgattacacgatttggccagcggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccgcctgaaagcaggggaaaggaatggggattttcgggctagcgatgatgtttgctccagcggtcggcccgactctttccgggtggattattgagcattatacatggcgcattatgttttacggacttgtgccgatcggcgcaattgttatcattgtggctttcttcatctttaaaaatatggtggagccgcaaaaaatcaaactcgatactcttggcgcaatcctctcgattgtcggattcgcctccttattatacggagtcagtgaagccggatctgacggctggaccgacccgattgtattgtctacagttattatcggagccattgcaattgttgcttttgttgttcagcaattgcgtcatgatgatccgatgcttgatttcagagtgtttaaatatgacattttctcactctcgagtgtcattaatatcattattacagtggcactttacactggtatgttccttttaccgatctatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacctatcaatacacgcaattgacaattgatacaccatatacacacatcatgctgatctattcaattcgtgcatttggtatgtctctcttaatgatgccagtcatgacagccgggatgaaccagctacctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtgaatatgaatgtgtcttatgatacggcgaaaacatatgtgtactcacatatttataaacacgcgtcactcgattccaatgtcatggggataaatgatgcctttatgtgggcaaccttattctgtgtagcaggtttgattttaagtatcttcctgcgtgacgtcagaaaagataaattgcgtaagaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcaattgctgaaggcgcgcgagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtcggtgctgtcttctgcacaacggcaacaacacacggcggcttggaaatgacaatgcacaatttaatcacgccgatgttccaccaaggcatgatcgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagtcacaggaaacctaacagcaggacagtaaggagaggttgaaatggccattattatagcaattattgctgctgtcattgtcattgcggcccttattacatttaatgtccgcagcgcctcacctggacctgagaagcaagacgcaactgatagaatcgcacctccagaagaggaaaaaaacgaagcgcattaccctgctgaagcaagggctgcggagcatacgccatccgttgtcaaaaacgattccccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgttttctcatgcgggtttgccttttttgctgtttccatcaattcggtttttatcaaataaatccatggaatatgttgtattccatcttgatctagtgtactatgttactcatacaccgagggttttttccgggaggtaaagacatgaattcttttttaggtttattaaagaaagatatcaagctttcaagaatgtggctgctagtatggatatgcggaatcattttcttattgggaacaggccatattatagcttctcgcacgaaagaacctctagtcatttttggtttttttgttgcagttgctttttttctgcttttcttatctcctgtttttgtgttttatcaccttcgcaaggaagggaaatcacagctttggctgtacaatccaaatggcggcttatggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtgttttggactgtttttcactctctcagaaattggcgcagaatgcggtgggctgcgatggttctgttggttgcagtgtggttattcttcgatgaatacatcataagccctttggttgaatctcaaaagcatttctggcctgtaacagtctattgcaattttgattttcacttctacaatgtttggatattggaattaaaacctatccatctgtctgtgctagggtttcctattactttagtcatcacattcttgctgctcatcatggcttcaaaactgcttgatcgtaaagtagaggtgtaaatatgaacaatcaattccaatcctcgaaaccgatttatctgcagatcgctgatcagatcttttataggctggtcaggaaggagctgctcccaggagacaagcttccttcagtaagagaaatggcgattcaaactaaggtaaatcccaatacaattcaaagaacttacagtgagatggaaaggctgggtattgtggagacaagaagaggtcaagggacgtttattgcggaaaaagcagaaatcgtagacgagctgaaagacaagctgacacgagaggtgctggaaggctttgtcaagcaaatgaaagagctggggctaacgaaagaggaaatggtagaagggattaaaacattcacagagggaggctaaaatggaaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtgaaagttgatgaagagcaggttacgagagaaatggtgcgtcaaacggcttatcttactgagcttgatatgttttatccgcatttcactgttaaagatatggtgaatttttatcagtcgcagtttcctgattttcaaacagaacaggcttataagctattgaatgagatgcagctgaatccggaaaaaaagatcaaaaagctatcaaaaggaaatcggggccggctgaaaatcgttcttgctttagtgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagatgaagtaatcatcctcgccaatggagaaaaagttgcgcagcgtgaagtagaagatattcgtgaacaggaaggcatgtctgttttgcaatggtttaaatcaaaaatggaagtttgctagaaagaggaggaatatgatgaaaacagtgttggaattgaaaaacgtgactaaaaacatcagaggccgaacgatcattgatgatctcagttttacgattcgtgaaggcgaggtattcggttttttgggaccaaacggagcggggaaaacgacaaccatccggatgatggtggggttaatgaaactgtcgaaaggtgatgtcctcatttgcggccaatcaattacgaaagaatatgccaaggcgattaagcatattggagcgatcgttgagaatcccgagctgtataaatttttgagcggatataaaaatctccagcaatacgcaaggatggtcaagggtgtcacgaaggaaaaaattgatgaagttgttgagctggtcggtttaacagacagaatccacgacaaggtgaaaacatattctctagggatgagacagcgtcttggcttggcacaatgccttctgcacgatccgaaagtgctgattttggatgaaccgacaaacggccttgatccggcggggatcagagaaatcagagatcatttaaagaagctgacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaatgatacatatttcttccaggttgagcagccgagtgaagccgctgctgttttaaatcagtacgatttgctgagtaagacaaatggtgtagaaatcaaactggctaaagaggaagtccctgcggttattgaattgctggtgatgcagcaaatccgtatttatgaggtcaaggtcataacaaaatcattagaggaccgtttcttagaaatgacaggtgaaacaaaagaggaggttcagcatgcttaatttgatttataatgagtggctcaaaattttcagccgagccggaacatgggtgatgatcggaattctggggctgacaatggttggatttgcatttttggcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtgacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctgttgctgttgattttatttatcggttctactttattagggttgatcttcttcggaacgggtggtgaaaccgccgcgaatattcatttaatctataaggatggccatgtcattgagcaaaacatgatggggcatttggccacaacgtatctttctgaatccgtctcggctttaatggtggcgacgatggcgtttatgctgtctgcggtattcagaaacagctctcttgcggttggtttttccatcttcttgttggttgccggtacgactgcaactgcatttattgcagcgaaatttgactgggcaaagtatatattgtttgctaatgtcgacttgactcagtatgtggatggcacaccgttaataaaagggatgactatgacgttttctctcgtcatgctggcgatctactttatcatcttcctgttgcttgctttcggaatcttcatgaagcgggatattgcaaactaataaataaagctgttttgcttatgcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcagaaaaaacaactgcttattgaaacttttttcggaaaataccatatttatttttcaatttgatatttatttgcggaaattcatctgctttctcgatatgtgatcatacgtttgccttagtatttcttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagttttgtccttgttcttctcgtttcatttactgcatgttcaccgtctgcagaacatgaatcgataaaaatcgggattgctgagtctgacggggcaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcactcaaaaatacaaacttaatttggcaccgctcggaacgacatacataacgcccatgggcatttattcaaaacgatatgaccgaatccgagatataccgcgaggagctgtcgtttctgttccggataaagcgttcgattttggcagggcgcttacggtgctccaggaagcgggtttgctaacgctgaaaaacggatttaacggaacaggttcagttgatatgattaaagataatccgagacacctgaaattaaaagctgtccggcaacaggatgcagtaagcggtgccgacgtgtttgtcatgaaaccatcagaagcaaaaaaagcgggcctgaacccgaaaaagcatacgctaaagagcggcggacccatgtctggggaagagatgaatttgattgttgttagagcggaggatcaagatcgggaagcgctgcaaaccattcttgagctttatcaagctgatgatacagcggcatttatagaaaaagaataccagggagatcttgtcccggcttttctgcctttgaaacgtctttcagattggaagaatgaattcgaacattgaattcattcttttttttctgaaaaacatactctgttccgtcccgtttctttcgctttgtaaagcatttgatcggcaagaatgggcaaggatcctggctgttccgtattattggggtaatgagcggccctagtgatatcgtaactgaaagctcttcaccgtttgttaatacaatcggtgcatcacttacagttctcctgatccgttcagcgatccgggctgctttatcaagagaacagttcggcaggagcacggcaaattcttcaccgccgatacgagcggcaggatcagtatttcggatgctctgcttcagacgtaaccccaactctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaattttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacggaatggcagcgatacaaatgataataaccgagtatagtgcagatgtgttcatcgtaatcagcaagcggcctgcagtgatcatggccagggccgttgccgttgaaacccagcctccataaagagcggcaatcataatagggatatttcgaagatcaataattgaatgctgataggtaaatccaaaaaccatcagaataaccccgagcaaaccgcaggccagtcctttaacagcttgaaaagatatgctgtcttttttatgtactagcctttctttaaacaggtgggtgaagagataattaaatgtgattaaaatggtcaaatttacaaacagttctttcagcaaatattatcacccttatataaggtactaaagatggaagggaaagaaaagaacaaaaaaggcattatataaggtttttttacttgaattgataagttaaaataattcgcacttgacccatcggaattagtgtaatatagtaaatgagaaaatttgaagggagagtttacctgctttggagactttactggttgtattacatgtatttattttatttttacttatcttagggctctttgttatgcagaaaaaacatgtttccttctctaaacgtgtatttactgcgctggggctggggattgtattcggatttgcgcttcagctgatttacggcccgacttcaaatatagtcattcaaacagccgactggtttaatatcgccggggcggatatgtcaaattgcttcagatggttgtcatgccgctcgtctttatttcgattctcggtgcatttacaaaactgaagctgacaaaaaatcttgggaaaatcagcggtttgattatcgggattttagtagcaacaacagcagttgctgcagctgtcggtatcgcgtccgcgctttcatttgatctgcaggcgattcaggttgaccaaggaagtacagagctttcacggggacaggagcttcagcagaaatcagaggatatgacagcgaaaacgctgccgcagcagattgttgaactgctgcctggaaacccgtttttagattttacgggagctagaccgacttcaacgatcgctgtcgttatttttgccgctttccttggagtggcattcctcggcgtaaaacacaaacagccggaacaggcagaaacatttaaaaaactggttgatgccgtttatgccattgtcatgcgtgttgtcacactcattttgagactgacgccttatggggtgctagccatcatgacaaaaacaattgcaacgagtgatcttgacagcattctaaaactgggcatgttcgtgattgcatcatatgccgcgttaatcactatgtttatcattcatttgctgctgctgacgttcagcggcttgaatccggtgatttatttgaaaaaagcggtgcctgtacttgtatttgcatttacgtcaaggtctagcgcaggtgctttaccgctgaatattaaaacacagagaagcatgggtgtaccggagggaatcgcaaactttgccggttcgttcggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggggttgccggagtcggcggcggagcgacattcgcggcgcttcttgttttatcatcattaaacatgcctgtcgcgctcgccggtttgttaatctcaattgaaccgttaatcgacatggggcgtactgctttgaatgtcagcggaagcatgacatccggtcttattacaagtaaggtcacaaaagaaattgatcaaggggcatttcatgatcaatccagagtgattgaagctgaagaagcgtaacatatgaaaacgtgtaatccaagaggattacacgtttttttaacggccaggctctaagtcctccagcatttccatcatcgtgttgtcgtccatgacattcattgcgctttgttcaaaatgaatgggttcagcataatgcggctgtctttttttcgcggctgtctcagtttgcctagtttgagactgtgtatgctggtgctgtgtttgctgctgtccggcgtgctggtgctgacggccattttgccgctggctttgatgttgcgaacggtcttggttatccccgctgcctccgccaaatgcttgtttgactatgtttcctacattagaagcatcaaatgtgttattttctgaatttcttctgttcatttgtcctgtgataaacccgctgattctttggcggatctgaggtgataatgcagcaataagcatagttgatcctatgatcaatgctgcggggctgattcctcttcgctggttaaacaacatgatccctcctttgtagtgtattcatattttccccctcgttagacaaattaaccgttatatttcccgggaaagcatttcctccagatttgcatgcataattaaacccagttagaaaaacctataagtaaagtgataaaggaggaattcacatgtttggaaaaaaacaagtccttgcgtctatgcttcttatccctttgcttatgactggctgcggtatggccgaccaaggtgagggcagacgtgataataatgatgtaagaaacgtaaattatcgaaatccggccaatgacgatatgcggaatgtaaacaatcgggataacgttgacaacaatgttaatgataatgtcaataacaatcgtgtaaatgacgataataacaacgaccgaaaacttgaggttgctgatgaagcagctgataaagtaacagacctaaaagaagtaaagcatgccgatatcattgtggctggaaatcaagcctacgttgcagtcgttttaaccaatggaaataaaggtgcagtagaaaacaatctgaagaaaaaaatagccaaaaaggtaagatctactgacaaaaacattgataatgtttacgtttcagctaaccctgattttgtagagcgtatgcaaggatatggaaagcgtattcaaaatggtgacccaatcgccggattatttgatgaatttacacaaactgtacagcgtgtattccctaacgctgaataaatgaaagaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtaagctcagccatcgtatcaagcgcgatgtatatcctgtcttttccaggtcaggcatctggaataacaaaagaacaagtgacgaagcacatgaagaaagagtcattcaaacaggccgatatttattacacttctaaggaaaagtccttactgccattgacgaaagaaacgcttgaatatgcggtcagtattaatcagattatgattggatattcgaatcaaaagcctattgacattattttttttcctaatgaaaaacagatggaggcttactccggtttattggatgtagttggtttttattctgaacgggagcagctgatcggattgttgcctgaagagaaaaagaaactgttagaaggggacgaggtagcagtttatttgtaccagagattgttgattcatgaatactcgcaccatgcgtttcaccagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagctagagccgaatatgacactgatgtctatttgcaaagcttttatatgatcgatgagctgacggacaaatacgggaaagacattatttcagaaatgattaaggaaacggcaaaaaaaggggactttgaaaaagggtttaaatcagcaacaaaggaaagtcttgatcaatttgaaaaagattttaagaaaaaatttgaaaaaaacagtgcggcattggatagtatctatccaatgcctttgttattagtgaagtccttgctgacccattccgccttgtgtcggaggcatttgtccttgggcaggggcgaatgaatttcgcagctgttccatatcctgcgcatcaagctgaggaacctggtaatagccgtgtttgttttggtataggaaaatttcaaatgccatttcaacatactcctgaatttgcgcagacagtacgcgtcttacggccggatttgtcatttccagagaagccatcgtcagcatagaagcttgtgctttaatcgcgcaaagcatttgtcggctgatgatgctgtcatcaatatcattcatggattgaacaggttttttaggctgtgacggctgcatgccgtaaacagtctggttgtcttccttcatcatataagttgctgttttttgtgaaggttcgcttcctgttttgaagcattctgcagttatattgtattgagatgtgatgaattgatgttgacgatcaaggatgtttagtaattcttgatccttacagaattgtctcagcatcataaactgatcaagcacagtaagtgttccggaaagcacctcatgcatatcaaacatttcatgtccgccgtggtttttatgcggtttgccaggaatacctttgttcatttgggattgctgctgctgattgaactgatccaaaccgaattcctccttttttttcagatcagctgtattttgtgtcagtctgccgtgtattatgcagaagcctgaaaggaattatatgctgtctgtcgaaatgataagcagacaaaatcgttgtcattatgtgtataagggaggaaatatgatgaggcgtattctgcatattgtgttgatcacggcattaatgttcttaaatgtaatgtacacgttcgaagctgtaaaggcagctgaaccgcaacagcctatatcgattgagaaggcaatacagcaaaaagaaggacaggcgcttgtcgaaggatatgcagtcggccaggctgtttccccgcagcattataagctgacaagccctttttcaaatgattataatgttgcgctggcagaccgtaaaaacgaaacatcgcccgaacacatccttcctgtgcaaatcccctccgccttcagaagccaatttgggctgcaaaccaatccgcttcttctagggaaaaagataacggttcaaggaaagcttgaaaattactttaacacgacaggacttaaaaacgttcagtcgatgaacgtaaccgatgacacaaaaactccgccggctgaacagcaagtgaccataaatgaagcacggggaaggctgaatgaagaagtaacgataaaagggatcattacagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcacgtcttaccaggggctgaaagaaatcgttccaaactcatcaggcatcaaaatcaaccagtcaaatcaatccctccccgcccccaaacacttaacaatcaatgaacttattaacggcagcctaggtgatcagtatgaaggacgccttgtgaaactaaccgcttttgtttcctcaattccaagttctcctgccggcggcggttacaatgtaacaatgattgatgacgaccatcatgcaatgacgctccgggttatgaatgaaacaggggtgataaacgagcttgatgagggcaaatggtatgaatttaccggtgtgttaagcagataccaaacctttcagctgcttccgcgaaaatcggctgacctgaagctgcttgaagagcagcccgcacctccgtctgcagagggagaatatgaagggattgttgaccgggtagttgacggcgataccattcatcttaaatctccggtgcttggaacgacaaaaatccggtttgtaaatgtagatacacccgaaacatatcacacaccaaaaaatgacgcagatgaaaatcaattaagatttggcaaaaaagcatctgactatctaaaaacggttctgtccccgggtgataaaattactgtcaaggtcgggagtgaagccaaggacagctatggcagattgctcggacaagtcataaccgaatcaggttcaaacgtgaacttagagcttgtaaaaaacggctatgctccgacgtattttatttggccggttgacaatgaagaggattatcagcagtttcaggccgcagtagccgctgcaaaaaaagaccaaaaaggaatttggaatgaaaacgatccgctcatggaaatgccgtttgaattcagagccagagagcaagggaaaggcctgacaagatatgtggggactcgtcgaataaaacatatgtgcagccagctcactggaagaaggtagctgtggaaaacagaattttcttcgcttcagcaagtgaagcggagagcgcgggatataaaaaaacgcaaacggcacctaaagaacatgtgccgcttagaattctcagcatgaatgatttgcatggcaaaatcgatcagcaatatgagcttgatcttgatggaaatggaactgcagacggcacgtttggacgcatggattatgccgccgcatatttaaaagaaaaaaaggctgaaaagaaaaactcgctgattgtgcacgcgggagatatgatcggcggaagctctccagtttcctctcttcttcaggatgaaccgactgtagaactgatggaggacatcggatttgatgtcggaaccgtgggaaaccacgaatttgatgaaggcacggatgaactgctgaggatcttaaacggcggtgatcatccgaaaggcacaagcggatataatggacagaatttccccctagtatgtgccaattgtaaaatgaaatcaactggagagccctttttgccggcttacgacatcattaatgtggagggcgtacccgttgcttttatcggagttgtcacacagtcggcagctggcatggttatgcctgaagggataaagaatatcgagtttacagatgaagtgacagcggtgaatgaggcggccaaagagctcaagaaaaaaggcgtgaaggccatcgtagttctcgcacatatgtcagctgaacaaaacagcaacgccattaccggtgagtctgctgatcttgcaaacaaaacagattctgaaattgacgtgatttttgccgcgcataatcataaggtagttaacggcgaagtgaatggaaaactgattgttcaagcgtatgaatatggaaaagcgataggtgtcgttgatgtagagatcgataaaacaacaaaagatattgtcaaaaagtccgcggaaatcgtatatgtggatcaaagtaaaatccaacctgatgccagcgcttcagccattttaaagaaatacgaagctattgctgaaccgattatcagcgaggtagtcggcgaagccgctgttgatatggaaggggggtattcaaatgacggcgatacacctcttggaaacctgattgcggatggtatgagagctgccatgaaaacggatttcgcccttatgaatggcggcggcatacgtgaagcgctgaagaagggctcgattacgtggggagatctttacaatattcagccgtttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatatgaaaatggcagatggcaccgagatccagcccgatgccacatatacattgaccgtcaacaactttatggcgacggcgacaggagccaaatatcagccaatcggactgctgggaaaaaatccggtgacagggcctgaggatttggaagcgacagttgagtacgtgaagagttttgatgagccaattgcgtatacaaaagagggaagaattaagcttgctgaagtcagtgatattgaagaccctgtaacagaagacccgattacggaagagcctggagatgatccggggacggaggatccgattaaagaggatccaaggccagatgaagatttgcctgatataaaagaaactccgggaacagcaccggttcatcagcttccgccttcagccatttcgagattcaatgaaataccaatcaacaacacaaaaaccgctgatactgctaatagcatcagcacattgccgttacaaaccgaggctgcggaaagcgggtctgatcatcagcttccggatacgtcagcgggctactataactttatggtaatcggtgcggcggtgacattgtcaggaacttatctatatgtcagaagaaaaaggagcgcctccagaacgtgaaaaaagttattccactattcatcattgctgccggcctagtgatcgcaggctatggaggctttaaattgatcgatacgaatatgaaaacggaacagacattaaaagaagcaaaacttgcggctgaaaagccgcaggaacctttggggacgaaaaatagcacagatcaagcaaagaacaaagcatcatttaagcctgagaccggccaagcgagcggaattttggaaataccgaaaatcaatgcagagcttccgatcgtggagggcaccgatgctaatgatttagaaaaaggtgtcgggcattacaaggacagctattatcctgatgaaaacgggcaaattgtgctgtcggggcatcgggataccgtgtttcgccggacgggagagctggaaaagggggatcagctccgtcttctcctgtcatatggagaattcacatatgaaattgtaaaaacaaaaattgtcgataaggatgacacatctattatcacgctccagcatgaaaaggaggagcttattctaacgacctgctatccgttttcatacgtcggaaatgccccgaaacgctatattatatatggaaaacgagtgacttaaaaagccgaggcagtgcctgcggcttttcttcatgaaaaatatgtgcggcaaaggttttccatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatgtccgaggctcgccagatgaacacggatttggtgtgttctgcctgtttccagctctaattcaacgagcgacagccgttctttcgcattgctgaccattaccttgaaatgagtgacggctgtttgcccgcctggtgaaacccggcgtcttgtcgggtgtgatcggtctctgccgatcggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgatacgcgatcaaattagccagtgtgccggtttgcccatcctcattcggatgcgttgcgatgccagcgggtttattgacgatgagcatatgattgtcctcatataaaatatcaagctcgccatactccggaatgaccgaagatgcttcactttcctgaagatcaatgaacacgcggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgtctatggagctgatccatgatgtatttcctctttatttctccgaactggacattcagcgctttaaaaagaaaggcgttctgtctttaaataaccattattaccaaggaacattaaaagaagcatttcaaattatggcttgtctgcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctaatataatcatgcggcaagggcttttctatttttagaaaagctctttttgtatcagagaaatcatatcataaaacctttcctctaactccctttttaaacggctcgtgtctgaacatactaatgattgaaaggggtgctgacaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcggacttgtttcggggtatagtgagtgtatacatatgtctcaattcgtactaaaggagttgtacccagtgattaaagcgttaatttttgattttgacgggcttattctagatacagaaacacacgaatatgaggttcttcaggaaatatttgaagagcacggctcagtgctgccgctatctgtctggggaaaggtcatcggaactgctgcgggtttccggccttttgaatatttagaagagcagatcgggaaaaagctgaaccatgaagagctcacacaattgagaagagagcggttcgccaaacgcatggaaacagaaaaagcgagacctggtgtcgaagcgtatttgaatgcggcaaaggatttaggcttaaaaataggccttgcctccagctctgattataaatgggtgtccggccatttgaagcaaatcggcctgtttgatgattttgaagttattcaaacggctgatgatgtggaagaggtgaagccgaatcctgaactctatttattggcggcaaagaacctggggtatcgccagcggaatgtctcgcgtttgaggattctgtcaatggttcgattgctgcgaaacgtgcaggaatgaagtgtgtcattgtcccgaataaagtaacgggcaccttgatgtttgaagactatgatcacaggcttgaatcaatggcggaaatggagctcgccctattgcttgatcatctgaactcacaaaactagaaaggagcgagtaggttgtctgagaaattagatttgacccggtttgaaaagaaaatggttatccgcaatatcgaagagaaagacatcgacaagattatcgatcttcaaaaggactgctttccggggatggaaccttggaagcgagagcatttaatcagccatttggagcattttccagacgggcagttttgtgcagaattcgaaggtgaaattatcggttcgtgctcaagtctcctgattaactttgatgaatatgatgaccgccatacgtggcaggacattacagatgacggttatatcaccaaccataatcctgacggcttgaatatgtacggaattgaagtcatggtgcacccgaaatacagacgaatgaagatcggccaccgtttgtacgaggcgagaaaggacttagccagacgcttaaacctgaaaagcatcatcataggcggacggattccaaactatcacaaatatgcagatgaaatgacagcgagagagtatgttgaacaggtgacacgccaccaaatatacgatccggttctttcttttcagctgatgaacggctttacccttatgcgaattaacccgaattatctcccagatgatacagcttcgatcaagtatgcgacgctgatggaatggaataatgtcgattatctaccgcagcagacaaaacgctattataaatcggcgttccctgttagaatttgtgtgatccaatacgaaatgaagaaaatttattcctttgaggaatttgcgaatcaagtagaatactatgtcgatgttgcttccgacgcaagatctgattttgcggtgttcccggaaattttcacaacccagctgatgtctttccttgaggaacggtcaccgagcttggcggtgcagagaattaccgagtatacagaagattacatcagcctgtttactgacttggctgtgaagtataacgtcaacattatcggcggatctcatttcgtcgaagaggaaggcaagatctataatatcgcttacctgttcagacgggacggaacaatcgaaaagcaatacaaactccatattacgccgaatgaacgcaaatggtggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagaccgtcaaggctatctgcgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgcccgagacggcattgtcggcgaaacaaacccgaatattgaaatggttgtcatcggcgatgttgacctggaaattctcagaagacagcgccaaaacggtacagtgcgccagctaaaagacagacggcgtgatatttatcatattcaatataaaaaataattcccaaaaaacccgcctgaattggcgggttttttaaaacaaaagcggaattgtttaggtgctttctttaaaaaaagtaaattgtatagtggaggagccttatggagtttctgtattttcgccatttcctatatcatacagaaatcggctaggcttccattgctattgcaatggctgtccaagttgtttcgagtgcgacctttatcagtacgatgctgagcattgtcactttgcctgttttgctttggaagctgcatcctctttcttcttgagaaagggatgttttattatttacgcggtttattgactctgacccggtctggctttatattgaaggcagggaaatcatcaccaagacatcacataaagagaaggtctgtttcaattgaattggcattatagggaacgctaatgaaatggagatgatggggatggaaaacattcagcaaaatcaggtattaaagcaaaaagatgagcaatttgtgtggcatgccatgaagggagcgcatcaagcggacagcctgatagcccagaaggctgagggggcctgggtaaccgacatagacggacgccgctatttggatgcgatgtccggtttgtggtgcgtcaacattggttacggcagaaaggagcttgcggaggctgcctatgagcaactaaaggagctgccttactacccgttaatgcaaagtcacgcacccgcaatccaactggcggaaaagctgaatgaatggcttggcggcgattatgttatctttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcttaatgccgccggacggatatatgaaaaaggtggaggacatttgccggcgccacggagcccttttgatttgcgatgaagtgatctgcgggtttggacggaccggcgagccgttcgggtttatgcactacggtgtgaagcctgatatcattacgatggcaaaaggaatcacaagcgcgtatctgccattgtcagcgactgctgtgaaacgggacattttcgaagcgtatcagggggaagctccttatgaccgtttccgccacgtgaacacgttcggcggaagcccggctgcctgtgccttggcgttgaaaaacctgcaaattatggaggacgaacagctgattcagcgatcccgcgatcttggagcaaagcttttaggtgagcttcaagctctgagagaacacccggcagtcggggatgttagaggaaaagggctactgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccagcttgcgccgccattttgcctgacagaagaggacctttcctttatcgtgaaaacggtgaaagaaagctttcaaacgatataatataaaagtgatttattaaaggagcacatgatgagttttcacaaccagccgatcttaccggctattcgcaatatgaagcaatttgatgagtttttgagcagttcgttctcttacggtgttattcttgatattcatctcgggcagctgaagggcgtgatcaaagaagcgcaaaagcacggaaagaacatgatggtgcacgtcgatctcattcaagggattaagcatgacgaatacggtgcggaatttatatgtcaggatattaagcccgctgggattatttccacaagatcgaacgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgacactcattcaggaaataaaagagaaaacagggattcccatctttgccggggtttcatccgtacggaagaggatgtagagcaggcattgaaagcgggggctgtagctgtcacaacatctaataccaaattatggaaaaaatatgaaaactttttgacggaaaatgattgacaccgctttcatgcactgatacaattgcactaggttaatacattgtgatggagaactcggagaccacagcagctctttacggcaaatgtttatgcacccgtaaagcggtttgttgtggtttttttattctcttcttctctatcatgctttttaatcgtgactttaggaggaatgtgctatgacagcattttggggagaagtcatcggtacgatgctgcttatcatttttggtgcaggtgtttgtgcaggtgtcaatttaaagaaaacgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatctatctgcattacctcccgcactggaagtcaacggatgatcccgctgccaagctgggtgttttctcaacagggcccagcattccgcatacatttgcaaacgttttaagcgaagtgattgggacatttgtccttgtgcttggaatcttggccattggggcaaatcaatttacagaaggacttaatcctttaatcgtcggtttcctcattgtagcaatcggtatttctctgggaggcaccaccggctatgctatcaatcctgcacgtgacttaggtccgcggatcgcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatatttatacgaaatcacattctgctaaaacattatcaaattcaaaatatatttaatcaaaggggagacatcttatggaaacgtacattttatccttagatcaggggacgacaagttcaagagcgattctgtttaataaagaaggcaaaatcgttcactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaactgggcttttaatcgatccatacttctccggcacgaaggtgaagtggattttagacaatgtggaaggcgcaagagaaaaagcggaaaaaggcgagctgttgtttggaacgattgatacatggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcttcccatgtgtatgcggagactgttgattatcacttcttcggaaaaaatatcccgattgctggagcggcaggcgaccagcagtccgcgctgttcggccaggcatgctttgaagaaggcatggggaaaaacacatacggcacaggatgtttcatgctgatgaataccggggaaaaagcaattaagtccgaacatgggcttttgacaacaattgcttggggcattgacggaaaagtgaactatgcgttagaaggaagcatttttgtcgctggctctgccatccagtggcttagagacggattgagaatgtttcaggactcttcgcttagcgaatcttatgcagagaaagtggattcaactgacggcgtgtatgttgttccagcatttgtcggactgggaacgccttactgggacagcgatgtgcgcggttcggttttcggcctgacaagagggacaacaaaagagcactttatccgtgcgacactggagtcattggcttatcagacaaaagatgtgcttgacgcaatggaagcagattcaaacatttcattaaagacgcttcgtgtagacggaggagctgtaaaaaacaatttcctaatgcagttccaaggagacctgttgaatgttcctgtggagcgcccggaaattaatgaaacgactgcacttggcgcggcttatttggcgggtatcgctgtgggattctggaaggaccgttctgaaatcgcgaaccagtggaatctggataaacggtttgagcctgaattagaagaagaaaaacgaaatgagctgtataaaggctggcaaaaagccgtgaaagcagctatggctttcaaataaagtaatactatggtataatggttacaagttaataagaacggtcctgagatgaggagagaccacagcaccaaagtgtaagcatgcactttggctgttgtggtctctttttctatttaccgtgacaacaaggaggaaacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacatttggttcatttacaacatctatcgggttaagagtttatgacttccttgcaggtgtgaaaaagtcagaacgaagaagcatgctttcagcaaaagaaacgctgcaaaaagagcctttggtgaaaaaagacggcttaaaaggcggcgggtactatgtggaataccgcactgacgatgcgagactaaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacgggaaacatttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaattcaatcaattacatgttcccggaactgaatatcactgcgaatgacatcgaatccagctgggcggggttgcgtccgctgattcatgaagaaggcaaagatccttctgaaatttcacggaaagacgagatttggacatctgactcaggcctgatcaccattgccggcggaaaattgactggatacagaaaaatggcggagcacatcgttgatcttgtcggtgatcgcttaaaagaagaaggcgaaaaggattttggaccatgtaaaacgaaaaacatgccaatctctggcgggcacgtcggcggttcgaaaaatctcatgtccttcgttaccgcaaaaacaaaagaaggaattgcagccggtttatcagaaaaagacgcaaaacaacttgcgatcagatacggctctaacgtagatcgcgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttatttttcgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtagaaagggccagatctcaggttatcaagtgacagaggcacccgcttcatataaaataatggcataagctgatacataggaggacgaatatgacttggagaaagagctatgaacgctggaaacagacagaacatttagacccggaattaaaagagcgccttattgaattagaggggaatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgtcataaatctccggagttcgcgatggaagcggcaaaaacacttgcgacacaaggcatccaaacatacgtgtttgatgagcttcgcccgacgccagagctgtcattcgctgtcagacagctgaacgcttatggggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccaaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattacctgctttctgaaaagaaaaaacaaggtatcctgcctgataacggtgttgttctcaaaacgatcgtcacaagtgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgagtatggtttctatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaaacaaagaagaagccatcgacttaccaaaatcaaatgtattgaaatacttcctggaagacgggtcttggttctgtcttcgtccttctggaactgagccgaaggtgaaattttattttgccgtaaaagggtcatctttggaagacagtgaacagcgtcttgccgccctttctgaagatgtaatgaagacggttgatgaaattgttgagtcgacggcaaaataattcaagtatgagctgggtcattgtaaatgatccagctttttctttttctcattcaaaagtctgaaagaaaatcatcctacaagtgaagcaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgctgagtctgacaaaccttcaatccggatggatttttctgatcgaagaagatgggtcttatgcgttagcggccgacgcttatctgcccccggctttaagccgcaaggaaaaagtgctgatgtgcgaaggggagtgttattgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacagcaatccagcgtatgaggctttctaaatatcaacaaaaaaatgctcttttaatggagcgtaaccgcctcgctcaggagcttcacgattctgtcaatcaaatgctgttttccgtcagtttaactgccaaagctgcgaagacactaacaaaagatgagaatttacagcagatgattgatttcatccaaaacctatcacaggacgcgctcgcagaaatgaaagcgttaatttggcagcttcgccccggaggattggaaaaagggctggctgaagccattaaaagctatggtgcgctcattggattgaagatcatttttacacaaaaaggctgtcctgttctgactgatgagcaggagcatatgctatggcgtgtcgtacaggaagctttaaataactgcaaaaagcatgccggaacggatacggcgtatgtcagtctgagggcttctttgtgccatgcggagctggatataatcgatcatggggcaggatttcgctatgaagcgcatgccggtctgccttcacttggcatcaagggtatgaaagaacgggcggaaaaagccggcgctaagttttggattgagtcagcgcttggaactggaacaaagctgtccatcaggcttccgctaacaagccgaaaaggaggggcggtatgaaaattgtcattgctgatgatcatcatgttgtcaggaagggtctgcgttttttctttgccacccaggatgatattgaagttgtcggagaagctgcaactggaatagaagctctccgtgttatcgaagagacaaagccggatcttgtgctaatggatctgtctatgcccgagatggacggcattcaagccattaaaaaagcaatacagcaatttccggagacgaatatcattgtgctaacgagctactctgatcaggagcacgtcattcccgcgcttcaggcaggcgcgaaggcgtatcaattaaaggatacggagcccgaggaattggtgaaaacactaagacaagtgcatgctggcgaatacaagctttctacagctattatgccccatgtgctgacacatatgaaaaatcagcacgacccggaaaaagaaaaatactatcaattaacaagaagggaaaaagacgttctgactgaaatagcaaacgggaaaagcaataaagaaatcgcagccgccttgtttatttcagaaaaaacagtaaaaacccatgtatcgaatcttttagcaaaacttgaagtggccgatcgcacgcaagcagcgcttttcgcagtgaaatataatctgaatggagagatctcaaaatgaacatgttagtcataaatggcacgcctagaaaacatggcagaacaagaattgctgcatcctatatttcagctctgtatcacacggatttgattgatctaagcgagtttgtattgccgatttttaacggtgaagctgatcaatctgaactgttgaaggtacaggagcttaagcaacgcgtttctaaagcggatgcgattgtattattatcgcctgaatatcacagcggcatgagcggcgctttaaaaaatgccttggattttctaagcagcgaacaattcaaatataagcccgttgcattattggcagtagcgggaggcggaaaaggcggcatcaatgcgctgaacaatatgagaactgtgatgcggggtgtctacgccaatgtcattccgaagcagctggtgcttgatccggtgcatattgatgttgaacatgctacagtggctgaaaacattaaggaaagcttaaaagagcttgttgaagaactcagcatgttcgcaaaagcaggaaatcccggcgtctaaacgccgggatttgtttatgtgagaagggctatttgatcttcataagtcagctctgtggcatgatcaatataacggagaagggaatacagcatcttttctaaaacggcgtaatcctgttcaaaatgatacgcatgcagaaaatactcaattcgttttgacaacaaatcgtcctctgtacgcaccattaaaattaataaattatcccattgagaacgatgggtgtaataaagcgctttatcgtaatcggcataatccatgaatcgcttctcctttcttgggtgagaagttcatgattagtttatgccgcatcctctgtaattgacggggcaaaacttggcgtctgcggcagtaaaggggtagcaatatgagggagacataaaatcaaaatgcctgaatgaagatatcgcttttggtaaacctatgagggaacatattctgggtacaggagactgaaaaaatgaaatctctgccgtataccatcgcacttcttttttgcggattgattatcgtgtcaatggctgcaaaaggtcattcaacggacacaaacgagtccgttcaaaagtgggaacagcttgcctggagcaaaattcaggatgaatataaggacgcttcattttctgattatgcttatatggggcgtacagaggtgaatgatcagcagacgaaagatgtctttcgggtaacagtcagacagaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttgttcatattggaaatgacaactccggaatcgttggcatttatgaattccccgttgcctaggtaaattccgacgtgggaagggccggctttatatgttgtaaagaaaacgaaatctccgacagcaggctggctaactgatttcattgtgttccaatatcccgctgccgttaatctagatacggaagtgactttgttcagtacatagtaaatgaatccgctacagtcaaacccggacggtgtcgtgcctccccagcgatacggaaccccaagctgcgctttagcggccgaaatcattgtgttaatcttcgcactcgttgagctggtggtgtttgaagaaccggatgaagacgatgatgaagcttttccggaaatgaccagcttttggccaacctgcaagacatccgtttttaaattgtttttctcacgaatctgctgagctgttacattaaatttttgagcaatcacccataaggaatcaccgcttttcaccgtgtatgtagtcgtcgtgccggagcttgcatttgacgaagaagacgacgatgatgaagagcctgaagatgctttacctgtcagcttcaatacttgtccaacgtaaagcacatctgatttcagattgttgatatttcggatttgctgtacagtcaggttatagttgtttgcgattttccaaagtgaatcatcgcttttaacggtatatttagttgttgctgaagtttggttcgatttggatgaagtgtctttagaagacgtatcagagccgtttgattttgttttcaacacctgattcacgtaaatggtgtctgattttaagttgttcaagaccttcaattcagcgatggacatattgactttgtttgcaattttccaaagtgaatctccaagctgcaccttatatgttcccgtagaagatgaggaacttgaactcttattagaactgctttttgaactggagcttgaactcttgttagagttgctttttttactggaactagagcttgaagaaacagtaccggacacctttaatttctgcccagcacgaattaaatcgctgcttagtccgtttaattttttcagttcctgcaccgtcattttaaactcatttgcgattagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactactaaagttgtgccgacaatcgcagatgctgtcagccctgctgctaatttctttttcatcttagctctcctttttccccaatgattttgcatttgctgtttcttttttatatcggcacatttgtctcatcgttttgcctttttataaaaatagccaaattatcttaacaataagggggaaaaagggcataaaaaaagaaggaatcatggatctattccttcatttttaaaagcttcatgatatcttccttgtttttgacgaggtcgcgcagtgtatatttgtctaaaaccgcaagataggccaaaagcgcttcattcagcacatgttttaagccgcaaaccggggaaataacacagagattcttgttcgcatcaaaacattcaacaatattaaaatcgtcctccgtttttctgacaacttcaccgatgttgatgtcttcaggttccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataataagacctcagaataagacattttctatatcttatcataatcgattgaaaaatgaaaaaaaaggaattaaaaaacatgcacccagctgggtgcatgttttttgcttacatgtcattcggcggattttggtttttacggtttttttcgatttctgtgttttgcattttgcgttcaaatgtagacagataacgtgatgcaaaatccttaccgccaaggccgaaggataaaccgaaagcgagtgcgaagccgctaagaacgatgatgaacgcggaattgacgattgtcgcagcgacaccaagctgatccagggccataaagaaagcaagtgcgataatcgtatatttagcaataggcgctaaagacttgaattcctggccttttatcatgcttgagagcacttttctcaccaattctcctgcgtaaaggccgagtccgagaataaatactgcgacaaggacattcggcagatacgcgatgatgccagtggcaatttctacgaggaagtgcagccgaacaatttgaagcgcctcagctgtaaagagcagaatgacaatgatttgcgcaatcataccgacaacttgagacaaggacagctttgcaggcgttccggcttccatgcccattttccctaagacagaatcaaagcctgcgcgatgaagcagtccggacaccatggatttcacccattttcctgcccagatacccgctaaaacaagcacgatggcaatcatgatgttcggaagcatgtttaaaatcgtattcagcatagagacagccggttttgaaatgccggcgacatccagctgatcaagcgctgaaataaccaccggaatcataatcagcacataagcgattgttccgatgactgctgaaaggcttgtatcttttaagtaaattgataaacccatacgtgccgcgaatctttccgtgccgatgcttgcaaggaaattcgtaatgatatcacgaacaaggcgggcaacaagccagccgattaatacgataagcgctgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgatttttttgacaaggaagctcaaaacagaggctgcagcccatcctaacagcagaatgagtccggctttcagcacgcttgggatcgcagctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcgatttttgttttgctgagtcctttgtataccgctttttcaatgattttagcaatagcccagccgattaataagacgagtaaagcaatgattacgtttggcagcttactgagataagaagaaagcacgtctgctacattcaattggtatcgctcctttttcgtagtatggtgtgtgtttacccactgatccaataagcaaacagatgaatgtgccggggaattttttcttgcccgagtgagactatcatcttttgtctggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcacaagatgaagctgcactatgatctagggttaagtaagatctatgagctggtcattaactcagatccatgctacgcttttttgctggacagcaactcactgatccaaaataaattgattgtcgcacacgttcttgcccattgcgatttcttcaaaaacaactgccgtttccaaaacacgaagcgcgatatggtggaaagcatggcggcaacggctgaacggataaaacactatgaacaggttcacgggattaaagaagtcgaatcttttttagatgcgatcctttcgattcaggagcatatcgatccgtcgttggtccgaccaaagctccaatggagtgtggatgatgatgaagaggagattgaagaggcagccacgccttacgatgatctatggtctttggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttaacctctgatgaagcgatcgagttcgccaagctgaatgcaggtgtcgttcagccgtccaaaacaggcattaatccttattatttagggctgaaaatatttgaagacattgaaaagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggttttccatatttgacagtaaatgacggcgattatatgaaaaataacgagctctatattaagcattggtatgagggcatagagctggatttgaaatatttggagaaggtgctcccttatttattccagctttggggaagaagcgtgcacattgagtctgtgcttgaggataaggaagtcatgttttcgtacgacggaaaaggtgttcaccgcagatatttataaaaaagaggatgcagcgttctgcatcctttttattttccagtttttaaaatcttaaatatgatgtttgcctggtccgtattgttaatcaatccgcggaatttttcttttccggggccgtacgcgtataccggtacttcttcgccggtatgatcggtactcgtccatccgctgttggagcgggtattaaaaatcttgatgatggctttgtaggcccctttgcttttgtcagcctgtgcagctgcttcaacgcttttgatttcttcagatgtgaatttcagattggcatagcgggcgagcacatctttagccggcttgccttcactgatttttttggccatgaattcaggtgttttcttagcggagagaatcggttctgcgtgccaattcttttccccgtttgcgccaatggtaaagccgccggttgtatggtcagcagttgcaatcacaagtgtatgtttgtcttttttcgcaaattcaatcgcggctttataggcctgttcaaaatctttaacctcgctcatggctcctactgtatcattgtcatgggccgcccagtcaatctggctcccttcgaccatcaagaaaaatccttttttattttggttcaggcgatcaattgctgaaaccgtcatttctttgagagacggtgttttgctgtcacggtcgagcgccttagcaagccctccatctgcgaaaagcccgagcacctgctgatctttatttttcttcaatgcttgtttcgttgtcacatagctgtagccggcttgtttgaattcctttgtcaagtttctgtccttgcggttaaaataagattttccgccgccgagcagcacgtctattttatgtttgccttttattttgtcatccatatagctgttggcgatttggtccatgtttttccgtgattcattgtgggcaccatatgcggctggagtggcgtggttaatttcagacgtggcgacaagccctgttgacttgccttgctgtttggcctcttcaagtactgattttacttttttcccgtttttatcgacaccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccgtcgcctatcatcacaatgacatttctgatctcagctttgtcttgttttttggcgctggccttttctgtttgctgcagctcagctccggcaaagattccagctgtaaggacagaaacagcggcgattggcagaaattttgatttcatattttgaaacaaattcatttttttcatgcctcctttaatgtattccgtttatcatgttagggaaattttgttaaatgcggctgttgattatgtaaacaataagtaaagccttgtaaggaaatgaaaaaacgcttttcgttatcttgccttatttgatgtaaagcattcatttttcagaaaaatctttacctctctgtctttgcatgatatgtttgtttaaataaaaaaactgcggataaccgcagctctcctcgaatattctttaccactcatttttccggtatgtgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaatttaaaaaaagagatacatatatagagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagacattatttatgtgggacaaactttatcgattaacggcaaatctacgagttcaaaaagcagcagttcttcttcctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttcaacttctacttataaagtgaagagcggagacagcctttctaaaattgcgagcaaatacggcactacggttagcaaattaaaaagcttaaacggcttaaaatcagatgtaatctatgtcaaccaagtattgaaggtgaaaggaacaagcacaagcagctcaaaacctgcttcatcttcatcatcttcaagtagcaaaacgtcatctacatcacttaatgtgagcaagctggtttctgatgcaaaagcgttagtcggaacgccatacaaatggggcggaacgacaacttccggctttgactgcagcggattcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaacagtttcattcatgcaggatctgacggcgtacaaatcagcagcctgaacaacagctactggaagcctcgttacctcggtgcgaaaagattctaattttagagaaaacccgttcattggaacgggtttttttattagacggagcataggcgttttggttgctcctaaaaatgaaaatgtgataaaaaatccaagaattttttttctttcttattttcataaagggcaatcgcgtaagcgccggcatagggcagctgtacagactgataaggaattctgatcatctgtttctctgctaactcacgctttactgtagataaaggcagaaatgaaactccgagtccttccttgataaaccgtttcgttatatgtgtttgagtgaccttcattgttctcacaaatggaaatgtcattctgacttgacggagcaagtcgtcccagtaatcaggatgattgtgggtcaaaagcaggtattgttcgagcacctctttggcatcaatttcgttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgcttcatgacagaaggaagcacagtatctgcaataagcggagaaaccgcgagctgtaaggtttgagagtagccttgtctcactctgtgaagctctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtaggctgagataagaaaagcgtttccgccgtttttcggaagttctcatattttgcagcggtcacaaaggtgtgaagccatttgaaatccatttctattctccctctgattaatatttttaattaattccctttaaaatattcattattttttaaatattatatttactataataacagaaaaggatagggggaatacaaatggtacattacggattaaagggaattacatgtgtggaaacatccatcagccatattgatggtgaaaaagggcgtctgatttacagaggacatcatgcaaaagacatcgcactgaatcacagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtgctgagaacggttgtttcagcattgggggagaatacgtacacattccatccgaaaacagaggaagcaatccggctgattgcaatcacgccttccatcattgcatacagaaaaagatggacgcgcggtgaacaagcaattgcaccttcttcccagtacggacatgtcgaaaactactattatatgctcacaggtgaacagccttcagaggcaaaaaagaaagcgcttgaaacctatatgattctggccatggagcacggcatgaacgcatcgactttttcggcacgggtcacgttatctacagagagtgatttagtgtcagccgtcacggctgctctcggtacgatgaaaggtccgctgcacggaggtgctccttctgcggtgacaaaaatgcttgaagacattggagaaaaggaacatgctgaagcatatctgaaagaaaaactcgaaaaaggagagcgcttgatgggattcggccacagggtgtacaaaacaaaagacccgcgggcagaagctttgagacagaaagcagaagaggtggccggcaatgaccgtgatcttgatcttgcgctgcatgtagaagcagaagcgattcgtttgctagaaatctacaaaccgggacgaaagctgtacacaaatgttgaattttacgcagctgcagtgatgagggccatcgattttgacgatgaattgtttactccgaccttttcagcaagccgaatggtagggtggtgcgcccatgtactggaacaggcagaaaacaacatgattttccgcccgtcagcgcaatataccggtgccattcccgaggaagttctttcataacatattttggcgtttattcatttctgtcgtgtggtaacgttcagtatcaaccacatgtctaggagtgatgaatgtgaacccaatggacagacaaacagaaggacaagaaccgcagcatcaggacagacagccgggcattgagtcaaaaatgaatccgctgccgctgtcagaggacgaggattatcgaggaagcggaaaactgaaaggaaaagttgcgatcattactggaggcgacagcggaatagggagagcagcagctattgcctttgctaaagagggggctgatatctccattctatacttagacgagcattcggacgcagaggaaacacgcaaacggatcgaaaaggagaatgtccgctgcctgcttatcccgggagatgttggggacgagaaccattgtgaacaagctgtgcagcaaacagtggaccattttggtaaactcgatatcttagtgaacaacgccgctgaacagcatccccaggacagcattctcaatatttcaacagaacagctggaaaaaacctttcgcacaaatattttttccatgtttcatatgacgaagaaagctttgcctcacctgcaagaggggagtgccattattaatacgacatcgattaccgcttatgaaggggatacggcgttaattgattattccagcacaaagggtgcgattgtttcctttactcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggaggccgttttatttcaacgtgatcaacgaaaaaccagctccagagctggtttttttgtgtggtgaaaaatttcaaaataaaaaatttgtcgatttttctaacaattttgttttcatttttgcaattttatatataatattgagtaggagaaaggaatgattcgcgaccagtacaaatatagtagaaaaaaagaaaaatgaccattgttgctcatgaattcagaaaattcaaataaaatatataaaaatagatgatcgggagttgaaggggaatgaaagggagcgtttttaggaagaaaagcattcaggatttaatcgctgcgacgagcggggaaaagtctttaaaaagagaattaggggcatttgatttaacgttgcttggaatcggcgccattattggcacagggatttttgttctgacgggaacaggcgcagtcacggccggtcccgggctgacgatttcatttgttgtggcggcgttggcttgtttattcgccgccctgtcttacgcggaatttgcgtcaagtgtgcctgtttcaggttcggtgtatacattcacttatgcgacattgggagagcttatggcctttattatcgggtgggatttaattttagaatacatgctggcggtaagtgcagtgtcggtcggctggtctggttatttccaatcgtttttatcagggcttggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccaatgggctttggcggcgtattcagtgcagcggcgctcgtattctttgcttttatcggatttgacgctgtatcctctgctgcggaagagacgaaaaatcctgcgaaagatctgcctaaaggcattattttctctttactggtctgcacgattttatatgtcaccgtatcagcgatcatgactggggttatcccgtttgctcaatttgcgggtgtggatcatccggtttctctagttcttcaaagcgcaggacaaaactgggtggctggcatcattgatattggcgccgtgttgggaatgacaacagttatgctcgtgatgctttacgggcagacacgcgtcatgtttgccatgtcgcgtgacggacttgtgccgggctcactttctaaagtgcatccaaagcacaaaacaccttatgtagccacttggtttttcggaacgatgtcggcgcttctcggctcacttgttccgctggatgaacttgcaaagctggtaaacatcggaacgttgtcggcatttgtcctgatttctgtggcagttatcgttttgagaaagaaacagcctgatcttccgagagcttttaaatgcccggagttcccgtgatcccaggcctggcgattctgttctgcctgttcttgattttaaatctgggatgggtgacgattgtccgcttcctagtgtggctgttaatcggcttggtaatctattttctgtattcaagaaagcattcaaaattaaatcaataaccttttgataaagagagcgtccatacaggccgctctcttttctgttcttggcaaatgaatctatagaaatgaagacaaaaataagagataatataggctggaaaggaagtgacgtttattgtctgagcaaaaaccagtccaatgggcttcgaaaatcggtttcgtcatggcagcggccggctcggctatcggcttgggcgcgatttggaagttcccttacgtagcggggaccaatgggggaggagccttttttcttatcttcgtgttatttaccatcctcttaggctatccgcttttggtgggggaatttatttttggaagacggaaccagacgaatgccattgatgcatataaaaaagaagcgccgcgatcagcttggtttcttacggggtggatcggcgtagccgcgtgtttcttagtgctgtcgttttacagtgtaatcgggggatggattttgctgtatatcgtgaaaacagcgtcaggatcactgtccgggctttctcaagcacagtatggcgctctttttgcttctattatccaaaatccggtgcagacgctcgcggctcagcttgtctttatggcactgactgtactcgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatttgactccggaatccatattattcgcgctgggacaggccttctttacgttaacactgggggtttcggtgatggtgacctacagctcctatttgccgaaaacacaaaatatccctcgttcggcagcctccattgtcttgatgaatatcattgtgacactcttggcaggtttggctatttttccggcggttttctcattcggttttcagccgaatgaaggaccgacattgctgtttacagtgcttccggccgtttttgaacagcttccgttcggcacgttgttttttatcggctttctcgttgcatttttatttgcagccttaacctcagcattttcgatggttgaaattatcgttgccacaatcggaaaaggggacgaaaagaagagaaaaaaactgtcatggacgagcgggcttttgatctttttggtcggaatcccatgctgcttgtcttatggcgttttgagtgatgtgcacctatttggcaaaacgttttttgatattgccgattttaccgtcagcaatgttttgatgccttcaggcgctctgttaatttctctatttatcccgctgaaaatttcgaaaagcgaactcttggctgaaatgcgaaatggatcaaatgcaggtaaagcattcttttacacatggttttatttgcttcgttttatcgtgccgcttgccattattatcgtgttcttaaatttaatcggaattttatcattttaaaaaacaggctccgtttccggggcctgttttttatttaataagatgatatcaacggtgcccatgccgttttcagtttttggatgccgagcctgatgtcctcttctgacaaaccgccataaccgattaagacagaagtaaaaggcgtctgttctatatatgagggagacacgggatagagggttacaccgtggtctgcggctgcttttattgcttcttcctcacttgctggaaacaaaaggcgcagcaaaatgtgaagccccgagttcttaccgagaatctcaacggtgtttcctagttcagagcggatggcttctaacaggacagcgtgtttttttcggtataagcttctcattctatttatgtgtttttgccactctccggtttcgatgaagtctgccagtgccaattgcgagtgaacagagacggtctgcttcattaactgagcattgtttttgatcggttccatgagttcagggggcacaatcatgaagctgagccgcaaggaaggcagaagtgactttgaaaaagtgcccagatatatgactctgccattcggatcaagaccctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggtttctgacgatagagctcatccggcaggacgccttctgcatcagaacaaatcggagtgacatccatgtgatttgcttcaaacatccttcttgaacggtgaaagcccggttcttcaaagccgatttttgtaccttgctttagcgaaaggcaaagaatttgcagaagcacggtggttcctgcgccgatgataatctggccgggttcgcaatttactccccgagacagcctgacgaatcgggcaatcatgtgcctgagttcgtattctccttgagggtcgccagaggtgtgaaacgatctggaatagcgatcaagactttttactatgctttttctccatgcgttaaagggaaagagggtcggatcaacgttgccctgatggaagtcaatagcaggtgcgttcttttcatgtaatcccggctgtacagactgctgaaaatggtcaggagctgtcgggaatcctggttctacttccgccgcgaaccagccgattttcggcttgcttttgacatagccctcagcagttaattgctcataagcccgttctatagttgccgtgctgacatcgagcaagctggagagcctgcgttttgacggaagtcttgttccctttgttattcgcgcatgtgaaatttcttgtttaaaaaaggtataaagctgctcatacagcggtgttttgctctttttatcaagaaacggcgtaatatccatctcatgtctccttatatctggcatggtcattttttctgatattggctatttggctaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttgtggattgcggatcttgttacaacggcaccttgccgatcaaagggatacggcaaaatgcttttggattatgcctcagactgggcgagaaaagccggacttggttttgtcagtctttcatctggccttcagcgtaaagacgcacatcgattttatacagataaaatgggttttactatagaaagttatttgttccgaaaaccggtgtaatgaaaaaaagacgcctgaaaaggcgtcttttttaaaagccaaactgtaaattcgtatctacagatacaatggtatacacacaaataatcacaaagagattaaggatgacgccgagcaggcctggacctgtgcgccctctcttgatgaagagttcaacaacgccgaacggaacggcagccatggcgaacggaagcatttgataggaataaaacgtgacgttgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttctctacataatctaatcggttatctacattcaggtctttccgttttgaaatgacctgagcccatttttcgtgtttggacatgaatttcagggcgttgataaactgatcgccattcgacttgccttttgtattaagggcggccaagaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatggccggttttattcacttctaagtcatagtagtttactgccggcgcttttactttgttataaaacatttcaacccgttcattccctacggcagccgtcttcgtgccaatctgcttttgcagcgggaattccgtattcatcccaaatagcttcacttggcttttcagtccggaagtatcaacaagaacattcggcatggtcagggctacagtgactgcggcagtttccataaactcattgccggtgctgtgttttccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctcgagttcgctgtcaatcagttcctgatatacttcgagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggcaggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagtaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatgcccgcaaaagatagtgcggagaaatgtttaacattttttccagaggggaaaagatagtgaaggagtggcacaatggaatataccagtatagcagatacaggaatagaagcctccagaatcggcctcggcacatgggccattggcggaacgatgtggggaggcactgacgaaaaaacatcgattgaaacaatccgcgccgctcttgatcaggggattacactgattgacaccgcaccggcttacggcttcgggcagtccgaggaaattgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgttcttccttatgcgaaagataacaagataacaacattattatacggcagtttatgcagagggctgttaacaggcaaaatgaccgaagagtatacatttgagggcgatgatctgcgtaatcacgatccaaaattccagaagccccgctttaaagagtatctttctgctgtcaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatgcgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagatgacagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcctttccggtagatcgggagaatcccgggccaagcagtattaaaacgccgattaagctgctgaaagaaggagagatcgtcggtatcttcccaagcggaactagaacctcggaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataaacttgatcagctataaggcgttctgagagattgccctgaaactgtgaaaataagaaaagcaccttatacaaggtgctttttattatgcttcctgctggttagctgtctccagaagttcttcttcttgaagctttttcacttcaatatatgcgacgtggtggccgtcaatttcattaatgatgaattcgcagccctcttcgatgatggaatcatctttttcaacatcgtatttttgagtaaggaaccagccgccgattgtgtcgacttcttcgttctctaaatgaatgcctagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaatatggccatgtggaccctctctttttgcattttgacaagcaggtcttggattggcgcagattcaatgacatgaatgatcgggttgacgaattgagaaatggtggaatcaacagatacctcaccgcttatgcaggcggtcagcacttctttaatgttaataaccccgataatgttatctttatcgccctcttccacagggtagcgggtatatttttcaatctgaatgatgtccatcatttcagaaatcttgatatcatgcggaaggctgacaatttcggtccgcggaatcataatttctttcgcgagcctgtcgtcaaattcaaagattttattcacatatttaaactctgattggttgatttcaccgcttttatagctttcagacaaaatgatacgcagctcttcttctgagtgagccagttcgttttctgaaacggtctccaggccaaatgctttggtcaataaccgtgcagaattgttcaaaagccaaatgaatgggaacgcgatgcggtaaaaccaaatcagcggtttcgcaaacagcatagacactgcttccgccttttggatagcgactgtcttaggtgcaagttctccgacaacaacgtgtaagaacgtgataatggcatacgcaaaaataaacgatatgacatgtgaaagggaacctggaacgttcatttgtacgaaaagcgggtgaagcagcctttcaatcgttgattcacctaaaacccctaatccgatggaagtcaatgtaattccgagctgacacgcagataaatattcatcaaggtgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcgtttgagtgcattttcgtcgtagtaacggtaatttgaacaggatctggccggcgtaagcagaccaagattcgtataataatcaactgtccgtttcgttactccggcgagtgccgctagttcactgatgcgataagtctcagccccatctatatccctcccaaccatcacgttatagttatgagaatagtttaatatatgaatggtgtcttgcacaagtttattgtttttttagaccggaattggaagttgtggaattcatcatctgattgaagtaacataggaagatagaattttcaaatttttatatgcggaagggacagatgaaattggctgggttatcccgggaagttgaagaaaacttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaaccaagggcttcctgcagcgagagaaaaagtcgcgcaatttctggggtcgcgttttgaagctgatttctcagcggagcgtatcgtcatgacggtgggcgcgggaggcgctttgaatgttgcgttaaaaagcatcgtaaaccctgggaagaggtcattattcttgcaccttattttgccgaatataagttgtatattgagaactacgggggaaaagccgtcagctgcccgttgacaagccggtttgagatcgacattgaagcggtaaggcaatcgatcactccacagacgaaagggctgatcctcaatacaccgcataaccccacaggcacggttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggctagctcattcagtaaagatctcggcatagccggggagcgactcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagctggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaagaaggcaaagaaaagaaaacagttttcaaggctgttttctttttatatccgcaaaatccttcctcttccaatccagacaggcgcagaattgacaagcaggcatgcagttaaggctttcctcatgataaaagtctaaaaattaaaaatcatttttggaatgagttgtgttacaataaaatatacaatttataatcaaactttgacttttggaggtggtatgatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtaaggagatccagaatagatcagcttatcacagaaggaaacaaacgggcgatactcgcaaggcgtgtcattacagatttggatgaatatttatccgcatcccagctaggcattacattgacatcaatcgggcttggcgtactgggtgagccggcctttgaacggctgctgcatccactgtttgaaccgctcggcttgccggactcggtttcacatgcagtctcttttgcagtcgcgtacggcttgatcacgttcctgcacgttgttgtaggtgaactggccccgaaaacggtcgcgattcaaaaggcagaacagctgactttactgatagcgggccctttgcgtttattctatttgctcctgtttccgtttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagaaattatgataccgcggaaggaaatggctgctgtgtcaactgagatgacgatggccgagatgcttgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgacttgctgattaaaatgcagcgcgagcgcattcatatggctatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatatacgataaaggtgctgaagatggacggccgattaatcaagcaaatcgatataaaagaagaagccggcaacacaaccgggattacggcgcaccacaagctgccgctgcccgagcctgtgatgctgaacagtgcaaccttgagcgagaaataagctcaaggtttttttacattgtgattgtccagccgcaccaaaatgccaaaagcgacccgcaaagtgtcagggcgatgtacaagatgctttctattacacgtttggccataaggagttgaatactttcaacgctgaaagtggaaaaggtcgtaaaggcgccaaaaaaccccgtgccgatgataagcgaggccgaagcatttgtaacgtgaagtcctgtaaatattccgagcccgagagctccgagaatattgactgtcagtatgccaatgggcaggctcagacctttggttttggcggttatgacattgccaagccagaagcgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccacatataaaagagccaatgagggttgtccttgcaaaagcatcactgtttccttagaaaacgtggacattgttgtgaagcctccgcaaaagccggtgcctaaaaaagccgacagcagaggccgttttgcaccgatcataaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgccgctgtcttttgattgttgacagtccatgcaaatatgtttaagccatttttatggacggagccgatcatcagacggttgagccgtgtgtattttatattgacatagtttgcaaaagagcggaaggccttcatctgatttctggacagcatgccaaagttgggccttgtaatgaccgctgtcggaatcgaaggataaagctcgtggaacctttggacggagcggaactgaaaggattgaacaatattattgatagaaaaagaaaattgccctaatagctgtcccacctcttcttcaattccgacttgagacggatggccttttagttcaattaaaaggccgatttttttgtggtagcgcttgagcaccgctttcagggtcggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgcggcaatcgtattttccggagcgtagccggatgctccgcgatgggcaatgatgtacaagctaagtcagctcctcgtatgggcatttctgttattgtatcaaaaccatatatgcaccgcgatacaaactggtgaattttttctgccatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgacccggcgtttcgccggggttttgtgctgcaaaagacatttaaatgaacatctttacgaatattttagtataataaacaattgattgggatagaggggagacagtcatgccggattatctgcagcagtattttacgcttgatatcatcattcaaatcggcatcagcttggcgattttgctggtgtttcttatacttagaaaattattcacaagatatttctttaacctgctttttaatttgacaaaccggccgaaaacagaaatttttaaacaggtggttctggcgtttgataagccggccagatggttttttgttgcccttgggctgtttttagcgatccggtattcaccgtttttagatgagcaaatgtcggtcatcagcaaaatataccgctcactgattgtggcgctcttgtgctggggtctttgtaatttgaccgcaacatcgtcgtttatcttccataaggtgaaccagcgcttcgagcttgacatggatgacattctggccccgtttttatccaaattgctccgttttgtgatcattgcgctcagtgtcagtgtgatcgctcaggaattcaattatgatgtaaacggatttgtagcgggccttggtcttggcggactggcttttgcgcttgccgcgaaggataccatcagcaacttcttcggcggtattatcattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaaccttgaacgctccattcattctctcagaacaatgcttttagagcatgagggcgttgataatgaaacaatcatggtcaactttgatacgtttgccgacagctactacaatttattttttaacttctatacaaaaacgacagtttgggctgaaaaccttaatattagagaggatatcaactataaaattattgagattttaggtgcagaaggtgtccagtttgcatatcccggccaaatggttgttgtcaagcaaaagcacgaaagcgacccattccaggtgaatctaaataaagaggaaaaggaacgggcttaaaagagagacttcgtctgacagaggcggagtctttttcatggtaaaataagagaaaaaggcggtgttgagttggaagcattcaaaaatattctacatgaagcacagagaattgttgtgctgacaggagcgggaatgagcacagaatcagggattcccgactttcgttcagcagggggcatttggacggaagatgcctcaagaatggaagcgatgagccttgattatttctcaagtcatccgcgtctgttttggcccaaattcaaagaattgttccagatgaaaatgagcggcagctttgaatcgaatgaaggacacttgcttttagctgagctggagaagcaagggaagcaggtcgatatttttacgcaaaacattgacggtcttcataaaaaagcggggaacaggcatgtatacgaactgcatggttctatccagacagcagcttgtccggcatgcggcgcccgatatgatcttccccatttgctggagcgggaggtgccggagtgcacggcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagtctgattcccggcatgaagaaagtcatcataaaccttgaaccaacgtattgcgacagcttgtttgacatggtcatccatcaaaaaatcggcgagtttgcccgaagtttgggcataaaaaagtgagccgccttatgcgcctcacttttttattcatgaacaggaaccattgtgtcctctaacactccgaaggaatagcctttttcttttaatttattgattagtaccggcagcgcgtttacggtagcgggaagatcatgcatgagaatcacattcgggcggcctgaagagctttgttccatattttcaagctgctctaacacggccgtcacatactttgaatttcggtatttccagtccatgctgtcaatcgtccaatcccagtacacaaaaccgtctttctcaagattgcggatttgtgagggggttagtgacggcttgcttccgtagggcgttctgacaagagcggttttatatcctgtaatgtcctgcagcgtgtcacgcgcctcctgcatttcttttaacggagatgtcggtgattgatagaataatctgttattgtgggtaacgccatgtaaaccgagtgcgtggccttccttttctgctcttttcacagcttgtttgaattcgttcatccgcggtgacagcataaaaaacgtcgcttttacatcagcgcttttcagtacatcgagcaagcggtttgtaaaggctgacgggccgtcatcgaaggttaagtaaaccgttttatctcccatgtcctgctttgtctgcagatgttttatcagcagatcgggggagtcgtttttcagcttaaggctttccttctcatctcgaagctgtccgttagttgtgacagtgacttcctttgctttcgttgaactgttggaataacccaaaatcaccataagcaaaagcagcacacataaaactgctaaacttgcaaatttaaaagcaagcgaaactgcagaaggagaagcttctcctctcgtttgtcgcataacaatctctccattggcataaaatctctacataatgctgtacagcaggcagcttatgaagatgccttatgtttacaacctatgtattaccagtcaagtatacaggaataaaactggaaagcacatagaaaagttgtcgaaatgtcagattttaaggaaaaaataaactcctttccgctatagatctcttgatctttctgtttttcagcttgtccaatatggtagaattagtgacaatgacagcttgaatgacatcagggacatctcgaaaagggagggcttttatgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccgggcttgagccgcagactactgcttatacgtttacggtgaaaaaaccggagcaagagcaggcatacggagtggcggccattacagatgaggatcttcgctggctaagatgtgatatcaaaagtctgaatttactgtataatgtcatgacgaagcaaaaggcctatgaagcgggagcatttgaagccattttacttagagacggcgttgttacggagggtacttcctctaacgtttatgccgttatcaacggcacggtgcgaacacatccggctaaccggcttattctcaatggcattacacggatgaatattttaggactgattgagaagaatggaatcaaactggatgagactcctgtcagtgaagaagagttgaaacaggcggaagagatctttatttcgtcaacgacggcagaaattattccggtcgtgacgctcgatggacaatcggtcggaaacgggaaacccggaccggtgaccaaacagcttcaggctgcttttcaagaaagcattcaacaggctgctagcatttcataaatgaacgaagaaaagagcccgctttttacagcggggctctttttattttttaacaaatccaatcaaaatggagatcatcggcgatatatagaggaagaaagtaaatgggatgtagtctatgactggaacaccaagtgcgctcgccataaatgcgccgctgacgccccaaggaatcaatgggttaattaatgttccgccgtcctctaatgatcttgtcagaaattttcgctggatgttttgtttgtcatataaggatttaaatgattgtcccggtattaatatcgataaatactgttcgccggttgccaagttgacgccgatgcttgagcagacagttgctgcaacaagactgccttttgagcggatgcctttcatgacgccttccaatagtgcagaaatcaatccgattttctccatcaatccgccgagtgcaaaagcaatcataatgagagagacagagcccatcatggattgcagtccgcctctgttgataattttagcggctgcctcattgtcagtttcaaaagttgtgccattttgcaaagctgtcataaacgcctgcaggctgctgtcgggtacaaaaatagcagtcaaaattcccgaggaaataattccggcagtcagaacggggattactgatacccgtttaattgccagcaaaacgactaagagcggagaaagaagggcccacggtgtcacgtttgcagcatcttttattccggttatgacctgctgaatattatcggttgaagcagcgtccgctgacactgatgaaccgagaaagtaaaacagaacgacagtgatgagcaaagctggaatggttgtacccatcatatggcgaatgtgttcaaagatcggtatttcgcctattccggctgcaaagttggttgtgtccgacatcggcgacattttatcaccaaaacaagcgccgcatatgactgcgcctgctgtccattcaagcggaacgccggccgcgctcgccacgccgatcagcgctaccccgattgtgctaacagttgtcaggcttgagccaacaagtgtgctgatgatcatacatgaaaacaaagcagtcaacagaagatggcttggttcaataaaggatagggcataaactgtcacagtcggtatggcgccgctgtacatccaggcgccgattaagatgccgatcagcgctagaacgataatcggctgtacgccgtttttgatcccgtctacaatccctttttcaatgctcttccagggaaatccaaaccataaagctgctgctgaaagcatgacaacacttaaaaacagcgggatatgaggttctacatgaagcaagaataagcaagaaataataatgcataacatgaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcagatcggcagaaatgcggtttgcatgctcgataattgattcagccggatcgccttctaatatatcgatatctccatctgcctgctgttcattcagcatcattctggcttcggcgatgacttcttccgtacggtcttcatagatcattggctcaggtgatgttacatccgatatcagcggatcaggaacacttgtcatgcctccgcttatatagcttgcctcagctgcgggtctgggcgggtcgatgacggtctgattgtctttcatatcatgtgaatgggcgacggtaatagcggcatttacggttttagcaagatcaatggctgtcagaagcgctttcttactattttcacttccgtcaaacgcaacaatgatacggtcagcatggaacatccttctcaccctttcaaagcgtcttacaacactactacccgaatttgagcacaattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagacaaatacagaggcgagggctgttcgtgccaaactggatgaaaaaagctgcaaggaaaaaattgaaggcggctgatgaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatttgatggagaaaattcttcgtacgaagctgatggggcatttgctgactatgtcgccgccgttttatgaaaaaaaccgaacaggcgatttaatggcacgagggacaaatgatctacaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtgaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaacgtgatgcagcgcggcaatgcgtcattagaccgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctctaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcgggcagaaacaaagaatttcgattgcgagagcactcatggcgaatccggaaatcttgattctggatgattcactttccgctgtagatgccaaaacagaggctgcaattatcaagaacatcagagaaaaccgcaaaggaaaaacgacatttattttgacacaccgattatccgcggtagagcacgctgacctgatccttgtgatggacggcggcgtcattgctgagagaggcacgcatcaagaactgctggccaataacgggtggtaccgggaacaatatgaaagacagcagctgttcactgcggaagaagggggagcaggggcatgaaaataggaaaaacgttatggagatacgcacttctttatcgaaaattgctgatcacagccgtccttttgctaactgtcgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgtttctgatctgcctgtatgggggcttgcttgtgttttcggtattctttcaatacggacagcattatctgctgcagatgagcgccaatcggataatccaaaagatgaggcaggacgtgttttcgcacatacagaaaatgccgattcgctattttgacaaccttccggccggaaaagtcgttgcgcggattaccaatgatacggaggctatcagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtcagtcatataccggagatatgcgtcatattacaaccaaaaaatccgctcgatcaacagtgacattaatgcaaaaatgaatgagtcaattcaaggcatgaccattattcaggctttccgccatcaaaaggaaacaatgagagaatttgaggcattaaatgaatcacatttttatttccaaaacaggatgctgaatttaaactccttaatgtcccataatttggtcaatgtcatccgcaatcttgcgttcgtctgtctgatctggcattttggcggtgcgagcctgaatgcggccgggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggggatattctgattgatgggagaagcatttacaacatgtcaagacaggaactcagatcccatatgggcattgtgcttcaggacccgtacttattctcgggtacaatcggatctaatgtaagtctggatgacgaaagaatgactgaagaagaaataaaaaatgcactgcggcaagtcggtgctgagccgcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtaatccagaaagcgcttgatgtcgtcaaacaaggacgcactaccttcgtcatcgctcaccggctttcaacaatcagaaatgctgatcagattttggttcttgataaaggagaaattgttgagagagggaaccacgaggaattgatggcattagaaggccaatattatcaaatgtatgaactgcaaaagggacagaaacattccattgcataatgctcaaaaaacccaaaacaattgtgttttgggtttttggtttatgtagtcaataagccagtccgacacggtatccgacataatcacctgtaacgagctcacgatataaaaagtccgcagtatcgccgaccgaaatgcttgtgccgccctcaggcaaaacgttacgctccgtacgataaacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaaccggtattttcccggttcatatcgggaatctaggatccctgcggtgccgatcgtaataagccgtttgatatgctgttcctccatagcggagagaatgtgtgccatagcagttgacaaggtatcatcaccatctgtgcctagacagctgatcacgatttcagcattttccattatttttttcacatcttctaagcggcgggcgttccccatgacggttctgtcttttgaaaggggaagatcagcatgttgagatctgatcagagcgaaaatatcaaatctttcatctgctgcagcttgtgttaaaaaggcttgtccgacgcggccgctggctcctaataaagcgattttcatcaaaaaacctcctcgcctttcattataaaaggatgttctcagtttgaacagcgcgggaaagaatacctgtacaaataaacagaacgatgggaaacatattcatgaatcatggatacacttacgaactgaaccagctcccaattcacaatggtgatgaatgacaccccgattccctccctttttttctaggatatgtggagcaggaaaaaagggtgacaaaataaagagagcgcggaaaccgcgccctctatagccatatattgaattgttattgaactctgccgcccatttgctgctgagcgaaagatactaaacgttttgtaatttctcctccgacagaaccgttagcgcgagaagttgtgtccgctccaaggttaacgccgaattcagaagcgatttcaagtttcatttgatcgatagcctgagctgcgccaggaactagtaagtcatttgaagagttttggttagccatgtgtaaaatctccttttttgtttagtatggttgggttaactggagttgcaccaatctgtgaacccttctcgggtgtcactgccgcctcggcgtaacccaatgctttgccggcttgttactacgtattatgttaaaatgtccggaaactcatgcggagaattgtgtggtaaatcttgagaaagaaaaaaagcttagccgtttaggcggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaataaaggtttccagctgaaatgagaaatcattacggccacgctccttacatttggtatcaattgacctgaatataaacggcttatgttcattgtatcattgttccagaacatcattgaagaggccttaatatgcagtttgtcccagccttggataaagataagcccgctttattaaaaaagcggacaggttacgaaggccacaatgcttcaggagatatgattgccttctcagataaatatgacgcgtattcaaagcttcttcgttttgtaagagaatcaacatgatgcaaatttggatgagaaaaaatgcttcggcccgggcgcgaattcgcttcaaacatccatactttaccgttctgatcaatgccaaaatcgaaaccgatctccccgataaacccctcgatatgatcatgaaggacatggcttgctgtcagtgccgctgcagaaagcttttttatgacctcaactctttcagcgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccttgaaattcgatgagatcaacaccttgctgaatgagaaagtcggacgggttgtgctgtttttgaaattctgcaaggaatgaggcggcatcggaataatcaatcgaagtaaatgttttggcgtcattcgtatgctttaccgtcaggccgtcatctgttcttgtcagctgataaatgccggtgccgagtgctccatttgccggtttgatatagacttttttgtatgcgccacagagctcatcaatcagctccacagacggtgtcagctcggatctaggcaaaaagggtgccgttctcggatctttttcgagcaattgatgaacgttccatttattgaaaaacgttttattaaaccatgggatctgatattcatcgatcagcctcttttttgtatgttgcaagagaagtgaatcttcaatttttcggttcggcaaacggtcataaacgacgttcggcaatggaacgatttttttctcccagccgttttccctgtaaaggaggccttcaatcgtgccttcctcccaattgatttggtgcgcgccaaaaacgaagcagtagcccccggcttgctcgtgtaacgtgacaagcttagaaaaaaagagggaacgatccttaaatggacgttcaagagatacagtaaaccctgccgtaaagatgccgactaacggcccgatatgcactgtatgatcatgaatcagtatatcagccctgcttcggtggggaagcaaaagctcatgaaacagattttcagagagaagcacggtttgttccagatgccgtctgtaagcaacgtggcatctgacaaccttcgttccgaatgcggcatgcaaaagtccgtctcgcttcagcgaagagggcagaaacagggtgttttcactggttttgtctatgccgatcaaaaaccgtttaggattcacgcggaagaactcctttctggctttgctcagaaaacagatattggcagcgctttaggggacaagtgtacagctgttctttttgctcgggagagacacgcaggattgacttcctgcctggtttggaattgatatctaaaatccaaattctcccgtcctttgcaagacatatatcaagaccgagttcaaacaacggcccatagcgctcgtcaagataatacggaaccgattgggtaatcgaaaacacatcatctagtaaaaccacttgctgttttttcggtatatcttcaaaccaggagtcaaatgtcagcgcatcagatccgcctgacaaattggcgagcaacccgtgtttgtatccgcgtcttactgcctttccgactgtattccattcacctgcttcgtttttttccataaacaggcgaatatcacaagggtattgttccttatcttgaatgtttaagtaaggctgaagcaaatattgatgctgaagcacttttttgcaccatgtcttaaaagaagtctggttggaaaacgtttttgtctgcttatcctttccgatgtgataagtagcagtgatgtttttcttgcccagcttcaaaagaatcacgcctctgcctcccgcgccgaatgccggtttaaggatgcaggctttttctttggataaaaaggagtgaatttgttcgtagcggctcacctttatcgtttcgggaatatagggattgattacagagtgctgctgcaaatcgtgaaggacggtccacttatcgggaagaccccgcccgataaattccgttttcggatattttttgagccactcaacgattggttttgctttttgtgaatgtgaatccttgccgtaaaaacagcgatcataaatataatctggaatcgccatttcagtttcgttccatgtgctgctggccgaatgatagaccgatgctttgacacgcaaagtgtcaggtgaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgagtgtccgcagctttacgctaaatacatgtaagacgaacgcagctgacggtattctactttacagaatacgattctccaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgctattggagcggtgaccaatcatttagcaattcaaatgctgtttaggccgtataaagcgtactatttgtttgggaagcgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgccccgaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtccgttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcggaatgaggaaacaaataaattgctttctgatctcttaaaaaacgaatggggcaagctgagggagtatacgtttaatgaagcagacgaaaaatggaatgcaaaggcgctcattttcagtttgaaacgaagaatgctgcaagcattttcgactgcccctttcttcaacaatacgattggcacgcttaccgtccgctatgaatctgagctgacccagcaaatgctgccggcactattagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttgggggccttctcggcggaattataggcgcgattcaagcactgtttgtcatccttttttaagaagaaatggtttttgattaatgaaaggagctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagtagcgcttgtacagcagcacgaaaaaatttctcagctgatggaagcggagcagcgcatgagcatgctgattggtgaattgaacaaaatcattatgaagcctttggaagagctttacggcagtgttgaaggctaatcagcaaaatcccttcttggataagaagggattttttattcattcagcaaacttggaaatccaatgaatcttttacctctccattgatgatcactgataatgtatgaattcctttgtaatgctttctggtggttaaatccttaaaggattggtttcttgtgtatggcttcgtttcgttttttcgtatagttgtttcagttattttaaatactttctgatgacgctggcctcttgcttttacaaaatcaattgcgtactcaattcttactttttgatccctgtctgaatgaatagagaaagaaaattcaaggctttcgccaataactatacgtttgggctggcatgttaaatcatgtagttgtatcgaatcagcattttcataaccaaaaagcgctaaggcctgtttatcacccttttttaataaggtccgatgggcgtgtttgataatccagtctgtatggggatgtgttccgtaccattgatctgcgacttttctcagtaaatgaggatgcgtttttgatatatcattaaggttgttggccacgcttttccttacatataaggactcgtcctgcatcagcttctcaaggatcggcaatacgggggaagggtccgatttcaaagccggtatcgattttccccatggcaggcggggcctgctgccttcgctcgcaagtcttctcacgtgttcatttttatgctcagaccatgcaagcaattgtgcaatcatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggtgctgtatcccgtaaaattgcgagcgcttcaacgtattgttttggcaaagtttcgtataaagaaactgtcacgcggcgcatccgctcttttaaagtgagttcaggccagtcctccagccgtaatgtatccaagaatctgtttttgttaaaatcaggataggatgaccttacatgatggatcaactgagatatcagttcttcattatatatttcttttaaatcagccatataaaacaccgctttttcgtttattatttatattgtatgggaatgtacgttctggatcaagtgtatgatcctaaaaattaacaactgatcctaccacggatatacaaaagtcggttactttttttagttaaaaaaacccttgtcatcggaaaggaaaactgagataataacattgaaagcgcctacacttacctatttcaaatggatacggtcgcatatcatgccgttatatagaggggataagcaacagagagtaagtgttcggagcgcatcattggtcaaacaaggggttcctgatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagctatcaatgtaatattcggcttcttcacgaaaagtattccatcggaaacaagaaaaaggtgaattcaaatttattggggaaagcactcattcatccgtctgacccgatcttttatccagtccagttcgttgaatcattaagcgatctcctcatggatgagccggtgagtgcacccgtcatcgaggtgtatacggagcacgacattcagcatgacattacagaaacaattacaaaagccttccctgcggtggacgtgattcgcgtaaacgatgagaagctgaatatcgtcccgaaaggtgtttcgaaggaagcgggtttggccctcgtcgcttcagagctgggcctgagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaaaaagccgctcgcaccctgacaggtgcggcggcttttttgccggattgattttagcagtttatttctgtacactaaagaaagttttgaatctgataaattaggtgatgaagttgcaaattaaaatagaaggcatacatgatgaccgtctgcatcggcctctgcaaaatattgcaaatttgttttttgaagagtgcgagcttgcgtatggcggagaggagcccgcagattttgtcatttctttagcgttgtcacaaacggatgagcatgtgacggtttcgggagaagtgaagggaactggcataaaggaacagcatacaaaattcttttctcccggcatgaatgaaaaagaagcttttaagcaagtgaaaaacacaatttcttatgtgtatctcaatcttcttcaggcgtatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgatcgtcagctggcggcagtgccggatttgtatcgagtaaaggatgaagtcagcatttatatcggcattccgttctgcccgacaaaatgcgcgtattgcacattccctgcgtatgccatccaaggacaggcgggcagagtcggctcattcctatggggactgcattacgaaatgcagaaaatcggtgaatggctgaaggagcatgatgttaaggttacaaccatttactttggcggcgggacaccgacaagcattacagcggaggagatggatctgctgtatgaagaaatggtccgctccttcccggatgtgaaaaacattcgtgagattacggtggaggccggtcgtcctgacacgattacagaagaaaaactcgccgttttaaacaaatatgacattgatcggatcagcatcaatccgcaatcctatgaaaacgaaacgctaaaggcgatcgggcggcaccatacggttgaagagaccattgagaaatatcatctgtcacgccagcacggcatgaataatatcaacatggacttgattattggtttgcctggggaaggcgtgaaggagttcaggcacagtctttcagaaacagaaaaactgatgccggaatcccttaccgttcatactctttcatttaaacgggcgtcagaaatgacgagaaacaagcataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaattacgcattttgcgaatccgaaagatccgaaatcgtacaatgagcgcttcgagcactacacggacgaaaaaatcaaatatttagagcagatttttgagaaaacgacaaagcagcactgatcacagtgctgctttttttatccctgtttttttgcgggctggacatcaggcttccatttaaataccttgttcagcaagcggtaaattcgttttgattcctttgtgacaagcggtcccaaaatcgccagaatgaggacatataatgcggcaaacggctttaatgtggctgacagtccgccggctatcccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcaccgagcgaaaacggatcgatgctgaggccgaagctgaaaaagaacatcgcaccgaagaagtcgcgaaacggaacgacgaggtgttcaatcctatcggaatgctctgtttctgaaaagaccaaaccgagcagcagcgcgccgattgcttctgctacatgaatcgtctcggaaaacccggcgataaaaaagagcgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagcacaaggccggaaacaacggacagatatacggcaaggaaaatatcttcaaacatgatgatgccgagaatcaattcggtttccggattggcggttctttttaaatcaacgagcacttttgcgacaatcgcacttgacgagattgtgatgacgcctgcgaggatgaggacttccagaaaggaaaatccggtgataaatccgtaaagcagtccgaggctgaagttaatcaaaatataaatcgttccgccgaccgcgattgattttcctgatttgattaacttcccgacagagaattcgagtccgagatagaagaggaggaacagtacgcccattcgcccgaaaaactcaatgatttcactgctttgaataaatgttagatcaataatccctattttcggcgcgtgcggtccaacaagcattcccagcacaatcagaaacggaataatcgaaaatttaattttattggcgatcacactggcgattgccacaagcacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatcggctccgggatttaggagcttttcctggttgtgtttgataatggcaattacagtgacatcgtaattctggcggacatcaagctctccgagtgtgcgcccgatcgatttggcgcctttttcgaccttaaaccattcaataataagatcgctgaaggccatttcgatggactccagagcttgcggtttatagaccatgccccgagaatagctgcaatttgccttgcttcagaatcatccaatgaaatatttgaaagaagctcatccgggtcccggtcattaaaccggtaaatttcccttcttccgtcatcatgaatgataatcgtcattttttcgtggcttcttgtttcgatttcaaactttttgccgatgcccggcagatcgttttctttaatattcaatgaaaatccctccgaatgtagtgttggcagtatggggtgagttacaaataaaacttgagcaaattatattcggaggtaattagactggtatttgacagggacggcacaagccttttccagcctgtttatcagcggttcgtcaagtggtttgacagagagctgcctgacagactgcgccagcgggctgtactctttgatcagctcagccgggtgcatgctgcccggcgccggcgtttttgccgattgtgtttcctgcggatatgaggacataggcacatagctgtcagtgcttgcttcaaactgggaaggcagaaccacgtccgaagggggaaagtacaccataaataaacttaacagaaaactgatcagcaatttatccatgttcctttcctcccttctcgtcaagatatcccttctttttcactatataaaactttatgtttccattcaaacaatatgcatttttcagtatctattgaccttgaaaaataaaaaggtttatttgaggatggcgaggaatgtataggagaaagaaaaaagcaagcgcatacatggaggtgctttatatggagtttgttcaatatgcatgtaatggggccgttgcagagattatcctgaatcggcctgatgcccatcacgccctgaatgaacagatgctgtctgaattgaaggaggcagtcgaaatggcggctgcaagcgaggcgcacatcgttctcctgagaggaagcgggaaaggcttttcggccggcggtgatatcaggatgatgacatcagagcatgactctgatcaatttaaacggctgatggatacgattgaggctgtcaccctgaatttatatcagatgaagaaagtgacaattgcagccattcatggcgctgctgcgggactgggcctgagtttggcgctttgtgcggacattgtgctcgctgaaaaaaacgccgttctcgcgatgaattttatcggcattgggcttgttccggacggcggaggacattatttgctgaagaaaagaatcggtgaagcaaaagcgaaaaaactgatttggagcggaaaaaaactatctgcctcggaagctgccgatatggggcttcttgatgggacatttgctggagaccctgccgaaggcgcaagacccattatcgaaaccctgttggcctcccctcttttggcgatgatcgaaacgaaagctatttttcaaagcctccagattgaagaactgaaaaaagtgctatcccttgagcgcagcgcccaagagagaatgagaaggaccaaggatcaccaagaaggaatccgtgcctttttagaaaaacgggagccgaagtttcaagcgtaacagatcagccggaaagctgatcatctgtgaaacaaaatcagctttccgactgcattgactaaacgatgagtatgactatgaagctctttttcttttaagagggcttcaccatgcgtttttgctgcttcttcatgttctgcctcgaatcgctcgtttaccagcgtgttccccgaaggatcaaatacggtaaggaagtaatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaagacatttggagattataaagccgttgacggattggacttagatattccggaacagcaaatgttcggtttattaggcgcaaacggagcgggaaaaacaacgacgtttcgcatgatcctaggattattaagcattacggagggctcaatcagctggaagggccgtcctgtgaattatcatatcagcaacaaaatcggttatttgccggaagagcggggcctttatccgaaaatgaaggtaagggatcagctcgtctatcttgccagattaaaagggatggagaagcgagaggctgtaaaagagctcgggacatggcttgaacgcttcaatattactgattacgagaataagaaggtggaagagctttcgaaggggaatcagcagaaaatccaattcatttcggcagttttgcataagccggagctcctgattcttgatgaaccattcagcggcttggaccctgtcaatgttgagctgttaaaagaggctgtgatctcgctgaaaaacagcggtgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactccgatgacgatctgcgctttttgcagtcccatgaaggcattcttcaatggaaggaaacggcagacggtgtcaagctgcagattgccaatgaagacatttctcaagagatttttgctatgctccaaggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacaaatctggagtcgatcatttctttgtttcaaggtgacgatgcgaaagaaaaaatcgccgttgttgatgaaacaaacgaattatatccggttttttctaagcagctgaaagcggtggatacagacggcgattttgatgtgaagctgtcgaagcaatcggaggatgaggtcacaaagcaagtcaaagatgaatcactcgatggcatgctcatcatcaaacgagatgaaaaagggaccatttcaggaacatataaagcgttaacgatttctgatgaaagcacgtatcaaacgctgcagcaggcgctgacgcaaaccaaaacagctgtcggaacagcggagctcggcgtgtcgcaggaaacgattagcagcctttatgcgcccgttactgtggggcagaaggcgctgaaagaaggggcaaagtctgaggaagagcttggccagacggtagggcttgtttacattatgctgttcgttatttatttctcggtgattatgtatgccagcatgatagcgatggaggtcgcaaccgaaaaatcttcgcgagttatggaaatcctgatctcaagtatgccgccgatccagcaaatgtttgcaaagctgcttggtatcgggcttgtcgggatcacacagcttgctattattataggagccggctctctgtcgcttaagctgaaccaaaagagcgaaacggcttcatctgtcggcgggttccttaatttgaccgacgtatctgcaaccactgtcatctatgctgtcattttctttttgctcggatactttttgtacgcgacacttgccgcgtttctcggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgttcctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgatcaaacaagcgcttcgtttagcgaaaaactgattggaaaacagcctggggattctcaggctgtttctttattgacagaacgtgcattcgcaagaattcggtgctaaaataagggtacttcatcctggaaaggagcagaatgttgactgatctaacctttattcatgcggcagatcttcatcttgacagcccgttttacgggatatcgcatctgccggagccgatttttgcccggattaaagaaagcacgtttgcaagcgtgagacatatgatagacgccgcagtgagagagcacgttgatttcattttgcttgcgggagatctgtttgatgaagccaatcgaagcttaaaggctcagctctttttgaaaaaacagtttgaaagactcagagagtgcggaatttcggtatacgtcatctttgggaatcacgatcatcttggcggggagtggacgccgattgaatggcctgagaatgtccatattttttcgtccgctgttccagaagaaaaatcattttttaaagaaggcaggcgcatagcaagcatttacggcttcagctatcaggccagagcagtgatggaaaaccaagccgcccgctatcggagatcaactgatgcaccgtttcatatcggcatgctccacggcacgctgtcaggatctgaaggacacgatccgtattgcccgtttacacatgacgacctcgtgaaaagcgggatggattattgggcgcttggccatatacataaacgccaggttctatctgccgagcatccggcagtcatttacccgggaaacacgcaagcacgccatatgaaggagacgggagataaaggctattatctcgttcatgtgacaaacggagatatatcttatgaatttcagagagcgcacgatgtcctgtgggaaaaagcggcggttgatgtgacggaggcaaagaatatgaccgccctcttccaaatggtggagaacacgttttcgaggctgcggaaaaaggggagccctgtttgtgtaaggcttgttttacaagggacggcgccggaatggctgctggaggcgccaaaaggcaccttagatgagtttcttgaagctcttcaggagcaagaagcggaggaggaacgtttcgtttggcctcttagattggacgatgagacagaaaacgaagcaaacctaacaaaccttgatcctttttttggcggtttatttgaagacattgatcgcagcgatctgtcagacgtgctggaagggcttgagcggcatccagtgtatagaaggcacgcggaccggtttagccaagaggaagtaaaggaaataaaagagcaggcacagattttattgaaaaggcagcttaaggtgcttgatacatgaggcggtgacagctttgcgaattatatctttacatatctaccaatatggaaaattttccaatcggacctttcacttttccgcctctcctgtccaagtaatttacggattaaatgaggcaggaaaaacgacgatgatgtcatttattgaaagtatgctgttcggttttccaaaaacaaaaaaatatgaaccgaaaacaggcggtgtctacggcggtgttcttgaagctgaacatcctgaatatggggtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgtttgacgtattcgggctgcaggaaattcacgcctttaatcgggataagataggggaatttttgctcttttccagcttgtttggtgctgaagccgtatcaaagcttgattcaaggctgacgaaggaaagcgaaaggctctataaaccaaatgggcgaaaccctcaattgaatcaggagctggaaacgcttaagcagctggcagtgaagctaaaacaggctgaagcagaggaagcgggctatcatcagcttctcggggaaaaacgaacgcttgaagcccgccttgcagccgcggaaaccgaattgaaagagacggcgggacatatccgaatgattgagggagcgattgagcgaaaaccattgctaaatgaaaaagcgacactcgaacaggtgattgcagaatttccggaacatgcaggacaatttcctgctgacggactgcatcagctggaaaaatatgaatcccatctgcacccgaaatcagcacagcttgaggcgcttcgggtgaagatggcggagttggacaaacagaggcaaaagcttatccccaataaagaactattggcgaaagaaacgctgatacaagagctttcggcagggtttcatatgtaccaatcctggggagaacagctggccgccattcaggcacagctgcgccagacgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacgtttgaacttgcccggcaagagctggaagacgtggaaaaggccgttcatgccgcttcgtccgcgattcttgaaaacagccaaagaaaagataaagaagcagctcttagagcatatgatgaaacacaggggcagcaccaagagcaagcgaagctcagagaacagctaacgttttttgaaagacagcaggctaaacagaaaaagactgtcattgtagctggtatgttgttcatcgttctcttttctctgctgcagcaatggattcccgccataagtttcggcgctgcacttattgtgtattggcttgtatcaggaaaaccgtcttctcgaaacagccgagagacaagacagcccatgacggatatttcaccagcagaagctgaaatgcttagagaagcgttatgggaggatgaccgcaataagcagcaccttctcacacagcgtgcagcgctccagcaaaaagaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccattgaagcaggcaggctgaaaaagcaccggagaacattcgaagaacgcgtcagtatgcttcgtcccgtgaatcagagtcaggatatctccatttcggacgcccttcacacattgcggaaaaacattgaacgtgaaaaagaaattgagaagcaaaaaaaggaaattgaaacagatattcattatacaaaggaacagatgcttgaacttgagcaagaaatacagtatttccacgcacagatcgaacagttatttgccgcggctgctgcaaaagacagagatgcgttttttgccatagccgacatcagcaggcaattgaaggatacggagaacaagcttcatcacgtaaacgcacagcttcaaggcggacacccggaggaacttgaactggcagattccaatacgctttctgaattgaaagataagcaatttgttgaaaatgaaagaaaagagcggctgactgaggagatcgagcggctccgcagccaaatcgcactgctctcagtcaaacaggaacaattagaggcctcgggattggtgtcagacctcaagcttcaaaccgaaatgcaaaaagaacgtgtaaaagaaacggctaaaaaatgggcctcgatacaaatgatcaaacaggtgatcagaaacaaattggagcggcataaaaaaatcgagcttccgcgccttctagagacggcaggagaattcttccgccctctgactgacggaaactaccaaaccatttatttttccgaaacggatgattcgatcatggttatgcatcgcgatggaactgtctatcatgcggaagagctgtcacaagggacctgtgaacagctgtatacagcgatccgatttgctttggccgttacgcgccaggatgggtcaaagcttccgttccagcttgacgacagttttgttcattttgatcaggaaaggctgaaacgtgtattacatgttctgtatgatttatctgaaggcggtaggcagattttgtattttacatgccatgagcacgtaaaagatgcatttcatagcagccaaatcatccatttggtgtcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttttgacgctgatgctgcaagaccagtcaggcgatattgaagcgaagctgtgggatgccaagcaaagtgatgaagtgacctatgcgccgcagacgattgtcaaggtcgtcggcgatgttcaccattatcgcggacgcacccagctgaagctgagaaatatcagaccggtaagcgagcaagaaaacgtcaatattgatgattttttagaaaccgcgccgattccgaaaaatgaaatgatggacaccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaagcaatagcagatttatatccgtctcttgatcgtgatctgctttatgccggtgtcatcctgcatgatcttggaaaagtgaaggagctgtccggccctgtttccacttcgtacacggttgaaggcaatttgctcggccatatttcaatcatggtgacagagctttcaaaagcggctgaggagcttcaaatcgattctgaagaggtgttaattcttcagcatttgattttgagtcaccacggcaaagcagaatggggcagcccgaaaccgccgatggtgaaagaagcggaaattcttcactatatagacaatctggatgcaaaaatgaatatgatggacagagcgcttgagcgcgtgaagcctggcgagtatactgaacgtgtatttgcactggaaaaccgttccttttataaaccgacatttcataaataacttaaaaaggactgatgctgacatattcagctcagtcctttttgatgcgtctttcccgcacataactcgtctcattcccgcatatggttaagaataaagaatctatgcaaagggggaggagcccgtgttattttttccatggtgggtgtatctttgtattgtaggcattattttcagcgcatataaacttgtggcggcagccaaagaggaagaaaaagtagaccaggcttttattgaaaaagaagggcagatttatatggagaggatggaaaaggagcgagaacgccgcagttctcagcagcatgaagaagaaaatcaaaaccattccatcgcataaaaaaagctgtgcggctcaatgagcctgcacagcttttttattatttggaactgcttgaagatgaagaagtgctgttgcttgttgaagatgtattaaatgtgtctttcagatctttatcttttacttcgatgtcagccttcttcatgactttttgaacagcttcctgaacggcattgctgtcatttagtttttgttcaagcacttcagatttcagttcttttttcatatcatcgtatttgccgcgttcttctgtctttttaatgatatggtagccgtattgcgttttgacagggtcactgacttcacctgtttttaatttgaatgcagctttgctgaatgtttcgtccatttggccttcttttgcaaaccagcctagatctccgccttgtgaagcagagctgtctgttgagtattctttcgcaaggtcttcaaacttctcgccttttttcagctttttctctacttcttcagctgtctttttatcagcgacaaggatgtggcttgcacggattttgccttttaagccttcccagtactctttgatatcggcgtctgttactttgatgttatctttagccgctttttgtgtcagcaattcatattttacttgttcttttaggtaatccttgccatattgcttttcgagggcagtatattgatcgccaagctgcgttttgtattctttcagcttgttgtcaatttctttatccgaaactttatacttcttgtccaatactttttcttgcactagctgtgtcagtacgcttgcgccagctgttttcttcatgtttgtgtaaagctcgccttttgtgacatcgcctgcgtctgtttttgcgatgacttctttgtcgccgctgctgcaagcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagcccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattcccctctctctgaactgtcccatattacattaccaaatatttattaaaaaagatagaatgcaaattgaaaaatcgccatcagcaccagggtttgactacttttcaacaagaatatccaagccgtctgcttcctgatcaataaaagcggttttcggtgcttttaccagcttgagagccagcaggaaatcaggcagacagtagccggcgtgaatgcccgagatcatgcagaaataatgagcatgattcggaaatgccagtgctgcgtaaaacaataccggtgtaattagcaagaacgggcttactagtgaaatgagcattgttgtttttggtatacgtttccatgtgcgcatgcgcaatatgtaaaactttttttctatttttctttttttgcagatgattggcaggacatggatgactttatgtacaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgcgcttctcattgataaagggctgagcaaggaagaaggggaagcggttatgaggatatgcgatgaattgtcggaagagctggcaacacaaaaagcgcaaggatttgtaacctttgataagctccttgcgctttttgccggacagctgaatgaaaaattagatgttcatgaaacgatttttgccctgtatgagcaggggctttatcaagagctgatggaagtctttatcgacatcatgaagcattttgattaactgtttacaggttcaagctcttcagccggttcatccgccgcactgtcctttgcttttttcttcagttttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccgtttatcattcagccgtttggagaaccttaaatatccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgattgatttccaaagagccttgctaagctgagccattttctgggtgaagactagagcttctttcacatcatagggcggttccactcgattcattacgtcacctgcttctctttttctttttctctattatgccaataaaataaagattaataaagatgaaaatgtaagaattttttaataaattcacaaaccattgcgacgaaagggtttttcggccaaaaaaaatacgggtccaattttggcccgcatttttttcttttgaataggatattagttttgtaaggttttctccagctgtctgattttctcttcgatatcggcaatttctttttgcagatcctgctggtgaggcttgatctcttcctgccattttttaattgacgtttggagctcgccgcccacgtctttaataacatccgtgctttcttttgccgctttgatcagctggtcttttaatgcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaaataggattcattcagcatttttcatttttgttgaaatcctgaacttctatacatagcttgctttattttagcatattttttaagtgaaaaggagggagaaggttgtctgtctttttgattgtattatcctgcatcacacttgccttcgcttcaggcgctgtttactatatcagacttctcagccaggctgcttcttatccgcccaagagggttatccggcagaaagcgcttgtttgttcaaccggaaccgcctttacactatgtcttatctttttcacaaaactcctcgcttaaaacatgctgacatgctgcgggcgctctgttcaaaaaaacctctcccggaagcggaagaggttttgtgtgacaattatttagcagcttccataaagcttgaacgccttaaaatggtttgcacaatcggataaataatgatcattgagattgtattcagcacagcggccggcagaacaacagccgcgaacaatgcagcgaaaccgccaggcaaaccgacgatcaataaagctgacgatagaaacacaattcctgataagatggtcccgatcactgtcagcacagcggctgcacctgtttttcggctctttctgaacaagagaaacagggagaagaacagaaacgctgatacgggtttatcaatgatgttagggatctgtccggctggaaacgcggttgtaagcgcggaaatgattccggtcacaatcccgatgacgagtacattttgcacccgcgggaacagcagaatgcccatgaacatcatgatcagcatcatatctggtttcatgccgcctaaaaagggcggaataatggaatgaagcgctgcgccgattgcggcaaacagagccataatgactaactcttttgttttcataactatgctctcctctgctaagctttttgccctccaataatatgctcatcatttattgcgaaggctttacagaatgtattatgcaaacagtataccaaacggacggtttgcatagccagactttttactcattttcctgctggaatttcttcatgaacgcagctaatttttcacagtcttcgagagagaccgcgttataaatagaagcgcggcagcctccaaccgaacggtgtccgccaaggccgatcatcttcgcatcttttgctttctggacgaatgttttcgttaattcgtcatcccgaagcgtgaaggtgacattcatgcgtgagcggctgtcctttctggcatgtcctttatagaagccgttgctttcatcaatacagctgtagagaacctgcgctttttgttcattgcgctgttcaacagcttccacaccgccgttttccttgagccattccagaacgaggctcagcatataaatcgcaaatgtcggcggagtgttgtagagtgaatccgctttgacatgtgtggaatatttcaggatttttgggacgttcgcattttcatttttcagccagttttttttcataatgactacagtcacgccggaagggccgaggttcttttgggcgcctccgtagatcacatcaaatttggacacatcgatttttctgcttaaaatatcgctggacatgtcggctacgagcggaataggagaattcggaaactcctgccactgagtgccgaaaattgtattgttggatgtgatatgtaaatatgcgccgtcttttacatccgtaaggtcaacctcaggaatatagctgtaattgtctgtttcacttgtagcggtgatagacgtgttcccgaacaatttcgtttctgccagtgctttttcagaccaagcgcctgtcatgacaaaatgtgcggttttttcaggtgttaaaaagttcatcggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataacagacatgccggattcgttaaaatcaataaattctttctgtgctttttgcagaacttccagtggaagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgatttttggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcaataattttacaaaagatacaattctctgcacaatgcatgagggttcctccttatgaaattgtttagtatgtatacattcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaacctgtctctttatgacagcaaattcatcatttgttaaaagggaattgtttcaaatcaggccttgtttttggtactatgaagaaaaacactataaggggagaaactatgtctctgctatcggtaaaagacttgaccggcggatatacaaggaatccggttttaaaaagcgtatcattcacccttgaaccgaatcaaattgtcggcttaatcgggctgaatggtgctggtaaaagtacaacaatcagacatatcatcgggctgatggacccgcataaaggttcaatcgaattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgcttttaaaggaattccgaatggaaaagaggctgaagtggttcccggcccatttttctaaaggaatgaagcagaaggttatgattatgtgcgcatttttggcagagcctgcgctctacattattgatgagccttttctagggcttgatccgcttgccattaacgcgctgcttgaacggatgaatgaagcgaaaaaaggcggggcgagcgtgctgatgtcaacacacattttggcaacggcagaacgctattgcgattcgtttattattttacataacggcgaggtgcgggcgcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaacgatcacctcgtcattgttttgattttttttctagcgggcgctgcaagctggtacagcaaatggatacgggacattcccgctcactttccgtccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagtatcgttgcgatgccgctttatttcgaagtcacaccgggggcttcgctcgtatcgtatgccgcggtctttgtccaactgttgctgctgaaagcgtggaatcaggtaatggaatggcgcatgactttccaaaacgaccgcagcatgaaacggatggatgtcatcattcgctttgcggcgaatacactcgttctttattttgttttccaatctgtttatatgtatgcgcttctcgtctatgtcattatggctgttctttatctgtatatgtcttccgcagcaaaacaaaaaacatttaaatgggagagccatattgagtccgaattgagacgaaagcagcgtttctatcggattgccaacctgtttactgatgtgccgcatttgcgaaagcaagccaaacgcagagcttatctcgactttttgctgcggctcgtgccgtttgaacagcgcaaaacatttgcctatatgttcacccgcgcctttttgcgttcgagtgattatttgggcattcttgtcagattaacgatcgttttcgcgctgatcattatgtatatctcagccagcccgctgattgccgcggttttgactgtgtttgccattttcattacgggcattcagcttctgccgctcttcggccactttgaccatctggcgcttcaagagctgtaccctgtgaaaaaagaaacaaagctgaaaagctatttctctctattaaaaactgcacttagtattcaagcgatgctgatgtctgttgcatctgcctatgcagccggcttgaccggttttctgtacgcgctgatcggttctgccgttctgatttttgttgttttgcctgcttatatgacaaccaggctgaaaaagcacggaaagctgtgaactgaaaagaggtaatcaaatgacagataatcagctgctgatgcaggaagctttggaatggaaaatgcattttttgcgaaaggattccatgtttgaacgcttttcgaagcgtgtccagacgaaggtgaatgaacggattcctgaaaaaatccatacggtcgtcaccgagagtgtgagaaaaatggtagaagcgacaatggccggctccaatatcatcacttataaaaaggatacaagtgcactgtcgctcagtgaaaaaaatgaattggcgaaaaaaacgattgtttcttatcagaaagtggcagctgctgagggagtcggcaccggagcgggcggcatttttttaggcattgctgattttccgctgctgctttcaattaagatgaagtgtttatttaccttgtcttccatttacggctttaatgtcaaggatgcacaagaaaggatgtttttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgtttttttatagctgatgataggtgatcgcagcgccggcaaggaccttggccgctgtcagcatggctttttcgttgatatcaaatttcggatggtggtgggaataaactcggtctggctgttcgggagcggcacctgtaaagaaaaaagtgcctttcacgttttgtaggtaataagcaaaatcctcgccgcccatttgcggttcaccgtcaatgacctgctgaacgccctcggtattctttgcggtgctcaccaagtggctcgtttctgcaggatggttcacaaccgccggataaccctgttcataggtgtactcataggacgcgccgtgcatgctgcatattccttttacaactgcttcaatttctttctccagaatgtcccggacattttcatcaaaagaacgcgctgtgccgatgagtactgcttggtctgcgatgacattaaacggattgtcggcgatgaaggagcctgtcgaaatgacggcggattgaatcggattgactttgcggctgacaatgtgctgcaaagaggtaacgatttgagaaccgattaggacggcgtctttagtatcatgcggatgagcgccgtggccgccctttccgaagactttaatcgtaaatcggtccgccgccgccattacggcgccggggcggcaaagaatagttccgagcggctcagttgcccaaagatgagtgccgaatatcacatccgcgttttcgagacagccgtcatcaatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggctgggttcgcttccttctatatatgctaaaacccctctgccgccaacgtttgtgcggattgggactcctaacgattcataataggaagcaataaatgcggcggttttttcttcttgaaatgagagctcaggatacatatgaaaatggcgcctgatctcaaccatttcttcaaaacagccctcgagctgtttgtttatctctttctgcagtgtggatatggacaaagccgcttcccccttttctatgcttttccatgattgtatagaaaaagtctgaatatttcaactcatgctgtttcaaagcatcatcacagctgcgagggttgtcaccaaaaggccaatcgcgacgggaatgaagttttttctggcaagctcaaaaggatcaactttgcaaatggccgcggcgggaatcaacgcccatgggaccagtgtgcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggtggcaagctcctttgacataggcatcatatgggataaagcaatgccgagatcgttgacaatgccgtgggaacctttagggagtgaagtgcccagtatgctctcatagcctgagtcgccaagataaaagaaagcggcaatcgggatgacggggccgaaaaccttaaaaccgaacttaaatccgtcaataaaatagccggtgattttttcaagccctttatgcttatacacgaaaaaatgaacggtaaggaggatacagattgcagacccgccaattaacgcggtggcatcatttccttgtaggttaaacaagagcatgcaggcaatatctgcaagaaaggcaagcggaatcaaaaaagccagtatggaccgcaggcgttttggcaagtacagcgagttgtcttgttcaccggaaagaacgggggaaaaagaagctggaggctcctgttttttgcgttcgcgctgaatcatgataaaggcagcggttgttgttgtcacacccataatcagcacaagcggaatgctggccgagacgacatcaccgactggaatgcctgctgcatccgcagtcagctttggcgccgcttgaatgacaaagtctcctgacagggcaaaaccgtgtccgaataagttcatggccatagccgcggcaagaggcgtcaaaccggcacgtgcggctgcggggagcaggacggcgccgatcaaagcgacacctggagaaggccagaagaagagagaaatggcgaacatcaggcctccaatcagccaataggcagtcacaggccctctcacaaggcttgcaaagggagaaatcatcgcttcatttatccctgtttttgttaacaaatcactcatcgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattgctccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgctcaatcagatgatgccttaatactctattcgctttttgcagatgttttgggaagcattcaggagaaaaaatgatgcacaattcagcaaaccagttttttctataggcgatgatgctttccgatggttctaaatatgaaccatcctcgtgctgcatctcgtaatcagcaaattcgaactgaaaaccgcagcacgggcagatttcatgagaatgattgccttcatgatcatatggcggttcagccaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccacaaggtcagaatgacataggtgtcactgtcaagcggacggagcactcgaattgcttcaaagccaggctcattttcgacttttcccgctctgtttttaaatctgttttcaaacagcggacgcccttcctgagtgacggcaatattgttcaatactgcaaaaccgggatgcttgatctctccgacttggtcaatgacttcataagcgtgtggtgcctggaaaacggtttctccgtttgtttcatgaatcaaaatggcgttttcctgcccctgcatcaaaaggatattttctgagggatacttttctacgattgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaaaaagcttattcttcatgcttcttcaaaaattgttgatcaaaacggagatgaggttgcaagcctgtatacagaaaatcgcgagccggtctcgatcaatgagattccaaagcaggtcagagaagcgtttatcgctgttgaggataaaagattctatgagcatcacggcattgatgcaaaatctgtcggaagggcagtgtatcgcgatatattagcaggcggaaaggtggaaggcggaagcacaatcacccagcagcttgccaaaaatatttttctgacacatgacaaaacgtttctaagaaaaacaaaagaagtgatcattgcgattaatcttgaacgggattacagcaaggacaagctgcttgaaatgtatttaaaccagctttacttcggacatggggtttacggcatacaagcggcgtcccactattattttaataaagaagtaaaagatttgactgtatctgaaggcgctgttttggccgctattccgaaggcgccttctacgtactctccgattttgcatcctgataaaaataaggagcggcgtgatacaattctaggtatgatgaatgaccaaggctatattagtgcgaaagaggctgtcaccgcgcagggccggacgcttggattgcacgtgaagaaacagtcggaaacaccttggtttgacagctacattgaccttgtgatcaaagaggcggaagacaagtattccatttccggagagcagcttcttcaaggaggatatacgatcaaggtgccgctcgattcgaagctgcagaagacggcttaccaggtgatgaaagagggaagctattatcccggaacagatcagaatgccgagggaagcgcggtctttattaataacaagacaggcggtgtagaagcggccatcggcggaagggattacacatccaaaggatataaccgtgtcacagctgtccgccagccgggttccacatttaagccgcttgccgtatacggaccggcgatgcaggaaaagaaatttaagccgtattctctattgaaggatgagttgcagtcctacggagattatacgccgaaaaactacgacagccggtatgagggcgaagtcactatgtctgacgccattacgtacagcaaaaacgcgccggctgtctggacgctgaatgagatcggcgttgaaacaggaaaatcttatttgaaagcaaacggcattgatatccctgatgaaggccttgctcttgctctaggcggcttggaaaaaggcgtttcaccgctccagcttgcgggagcatttcatacatttgccgcgaacggaacgtatactgaacccttctttatctcaagcataatagatgaagacggagaaacaatagccgatcataaagaagaaggaaagcgggtattcagcaagcagacgtcttggtatatgacgagaatgctgcagcaggtagtcaaaaagggaacggctacgtccggcacctatcacggcgacctggcgggaaaaacaggttctacatcttatacaggcgtctccggcgcgacaaaggacgcctggtttgcaggctatacgccgaaaataaccggggcagtctggatgggctatgacaaaacggatcaaagccattatttgaaagccgggagctcatacccgacgcggctgtttaaggatattttgacacaggcaggagaaaccggtcatgtgttcacaaagcctaaaaacgttaaagaactggaaagcccgattgagctgaagccggtcaaaacactcacagccgattacacatttaaagcagcggggctctttactattgaattaaagtgggacgctcaagaggatgatcgggccgtatacagaatttatgtaaacaaggacggcaaggagacgcttcttgattcggttgaagggaagggaagctatgaaattccttatgccaacttattttcgggcgcgtcttataaaattgtgccttataatacacagacaaaaagagaaggggaaggaaccgattacgttcagccaaaattgttttcctcttaatggaattcggcgattttttgaactttgagctacatttctataccatttgcctaaaacaaggtatagtgtaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccaaattgatccggaacaggacgtgccgtacgtgcttgagacaattaaactgcttgtcaatgagcagctgaacgtcccgctcatcggtttctcaggtgctccttttacgcttgcaagctatatgatcgaaggcggcccgtcgaaaaactacaataaaacaaaagccttcatgtacagcatgccggatgcatggaatctgctgatgtccaagcttgccgacatgatcatcgtgtacgtgaaagcgcagattaaggcaggcgcaaaagcgattcaaatctttgattcgtgggtcggcgcattgaatcaggcagattacagaacatacattaaacccgtaatgaaccggattttttcagagctcgcaaaggagaatgtgccgctgatcatgtttggcgtcggcgcgagtcatctcgcaaatgattggcatgaccttcctctcgatgttgtcgggcttgactggagactcggcattgatgaagccagatcaaaaggaatcactaaaacagtgcagggcaacctggacccgtccattttgcttgcgccatgggaagtcattgagaagaaaacgaaggaaatacttgatcagggtatgaaatcagacggcttcattttcaatcttggccatggggtatttcctgatgtcagtcccgaggttttgaaaaaactgacagcgtttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgttatggcgtacggcacgccttataaggaagaagatattgaacgttattatacacatatcagaagaggcagaaagcctgaacctgaaatgcttcaagatttgaaagacagatacgaagcgattggcggcatttcaccgcttgccaaaatcacagaagagcaggcgcataatctggaacagcacttgaatgaaattcaggatgagattacgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgtgccaaagaagaggctgaaaaacttggcggcttaacgattacgtcagttgaaagctggtacgatgaaccgaagttcgtgacatattgggttgaccgagtgaaggaaacatatgcgtcaatgcctgaggatgaaagagaaaacgcgatgctcatcgtatccgcacacagcctgccggaaaaaatcaaagaatttggagacccgtacccggaccagctgcatgaatcggcgaaattgattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttggatttgtcgcggatcacttagaagtgctttatgataatgattatgaatgcaaagtggttactgccgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgagctgacacttgttgaggcaagtccgagagtcggcgggaaaatccagactgtcaagaaagacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggcgagagctgctatggatttcatcctgcctgcaagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacattcccgcaattttaccagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccgtggcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgttggaaaagccggagacgaatccattgtcgatctatcagataatgacattatcaacattgtgttagaagacttaaagaaagtcatgaacataaacggcgtgccggaaatgacatgtgtcacccgatggcatgaaagcatgccgcagtaccatgtcggccataagcagcgtatcaaggagctgcgtgaagcacttgcatctgcatatccaggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgtgcaatggcaatattgtgtaaaaaaatgattgaattgaacagcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgaaccttccgttccatgaaaatgtgcacagagcgctgtttgccattctggagttcaggaaaacacatcagctgacgattaaaattttccaagagaatgccgagattggtacaatggcagttcaggaagtgatccagaaaatggagcgagccatactgtcttatatcaaaagcaagattgaagacgggatcaaaagcggcgcaatcaagccgtgcgaccctgaactgacagcctttgtgatgctgaagctttatatcgcgctcatttttgactgggaaaaacaacaccccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcactgtattagacaaaaatccgaaaaaattggatctgaaataccacacaaatgcaggttctaactatgtaggggcaacgatcggcgaaaaagcgattgataaactgaaagcctctgtttcaaaagaagtgaccgagcaatatacgaaagttatttttgataactttaaagatatcgcaaaaggtttgagcgacgcgagcagcggcgcgaaaaaaattgatgacggcacaaaggatgcgaaaaacggaagcgcccagctgaaagaaaatctggcgaagctgaaggaaagcaccgctaccatcagtgacaaaacagcgcagcttgcagatggagcggctcaggtgacgagcggcatccaatcgcttgacagctcgctcggtaaattccaggacagcagcaaccagatttatgataaatctggccagcttgcagcaggatcaggcaagataacgggcaagctgaatgaactgaatgccggccttcaaaaggtgcagcagggcttgcctaatctgacaaacgggctggatcagctcaacagtaaagcgcaagaaggttctgagaaagcagcaaaagcggaaaaacttataaatgcgctcgatttaacgaagcttgaaacagctgtgaataacctcgaaaagtcagaaacagcgatgaatgaatttaaaaaacagctgtctgactttgaaaacagcttaaaaaaccgtgatcaggcatttaaaaatatcatcaactccagtgatttcttaacagcggagcaaaagagccagctgatcagctctgttgaaaagcagcttccgaaagttgatgcgcctgattttgatgaaattttaagtgggcttcctgcagctgatcagctgcctgacatcgcaacgataaaaagctcattggaagacgtgaaagcgcaggttgcccaggtgaaggcattgccggaagctacctctaagctttataacggtgcaaaagccactcaagacgcgattgacaaattaactgctggatctgagaagatatacaatggttcacagcagctgacagaaaaccaaaataaactgacagcgggtatcggtgaatataataagcagttcgcaaaagcaaaagcgggctcagagcaattggtgacaggaagcagccaagtatccggcggattgtttaagctgttagacgggtctaaacaggtccaaagcggatcatcaaaactggcagacggatctgcatcacttgatacaggtttaggcaagctattggacggcacaggagagctgtctagtaagctgaaggatgcggctgaccaaacaggagatatcgatgctgatgatcaaacatatggcatgtttgcggatccagttaaaaccaaagatgatgccattcattccgttcctaactacggtacagggctgacaccttatatcctgtcaatgggcttatatgtcggcggcatcatgctgacggttgtcttcccgctgaaggaagcgtcgggacgtccgagaaacggttttgagtggttcttcagcaaattcaatgtcatgatgcttgtaggaatcattcaatcattgattgtggcgacggttcttctattgggaattggtctcgaggtagagagcacgtggagattttacgtgtttacgatcattacgagtctagcttttctagcgataattcaatttttggctacaacgatgggcaacccgggacgatttatcgcagtcattattttagtgctgcagctgggagcgagcggaggaaccttcccgcttgaattgcttccgcatttctatcaggtcatccatggcgcattgccgatgacctacagcattaacggattcagagcagtcatttcaaacggtgactttggctacatgtggcagatggccggcgtcttaatcggcatcgccctcgtcatgattgcactaagcattacttactttacaatgttaagccggaaggaagaaacatcagaagaacagccggcttcataaagaaaaagaacttgtttccttggaaacaagttctttttttgttacattccccatttaataagcaatcctgtataggttaatccgccgccaaacccgaaaagcaaaacgatttgatcttttttcagcttcccggctttcactgcgagatcaagcgccaaaacaattgaaaccgaagatgtgtttccgtagtgctcaacactagtgagcgttttttcaatcgggaacggtgttttttcacaaattgactcgatcatgcgcaagttcgcgctgtgaggaacaaaccaatcgagatcatcagagctgagtcctactttatgtaaaagccgttcaaattcgccagggacagttcttgcggcccatttatatacctcgcgtccattttgcaccatttttccagaaccgacaagctgcacaccgtttatttcatttcgcagtccggcacgatacaaaatatcgccgccgttcccgcttgttccttgtacagacgcaagaaatcccggcgtttcttcatctcgttctactaacagcgcacccgcggcatcgccgaacagtacgcatgtcgttcgatcggtataatcggttacctttgataacgtctctccggcgatgacgagaattttttgatgaaggccagatgtgatcaatccatttgccaaatggaggccgtatgtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagtgttcctttataacggctcttgagattcttcaccgcttcgatgcataaatcagaggtaaattgatgttcatccgcaatccggcgttctctcattcctgtgcgctgaacgatccattcatcagaggtatcaacgatcttttctaaatctgcattggttaagcgtctgctcggcgcataggtgccgatagctgtaatttttgcttttgacatatgaatcactccttatggtcagattataacactagatattagtatctggtactaaaaagaaggtttttttacaaaaaaagagaagtgtagaatagggaatctatgaaaaagaaaaaggaggctgaaaaatggtcagtcaagaagcagtagtctttttggcattatccggggctattgcgtttctgttgccaatcgggctgattgtatggtttaagcgaaagtatggcgcctcgcttaaagtgttttttattggcgctctcacgttttttgtcttcgcacagctgctggaaggcggcgttcatgtttatgtactgcaagtgaatgaaatgacgaaagaagcgatgcaacatccattatggtatggcatttacggctgcttgatggcgggaatttttgaggagtgcggaaggtatatgatgatgcgattttttatgaagcgccatcatacttgggcagatggtctggctttcggggcaggccatggcgggcttgaagccatcctgattacaggcttgtcctctatctcacttattgtatatgcatttgctatcaatagcgggacgtttgaacagcttttggtcaatggcgacatcaaacaggcgcttttgccgatacaagagcagctgctgcatactccttcgtatgaatggatgctgggcggaatagaaagaatcagtgccattgccgtccaaattggtctgtctctgcttgttttgtacgcggttaaaaaccgccggccgctgtttttgttgtattctattcttttacatgcactgtttaatgtaccggcggttttatatcaaagaggaatcatagagcatgctgctgctgttgaaatcattgttgctcttatagcggctttatcagtttattggattgtaaaagcaaaaagggtgtttcaataaaaggtccaagcagcagcaatgcccgcttggaaaaatgtgaatggaaatattcattaagcatgggttatcagaatatttctgattcagtctttagcaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaatcgtgacaacgacatttctgttcatgtgaatgacgacagcacatagaaatccctcctcttcccatgctctctacagcatatgagagattgataggaaaagattggacgggtccctcgggaaaagagtatattttaagtagaaaataaaaggaggaatgccctatgacgtccgtacgtaaaacgatggagctcattaaagaacttgtatcgatcccaagcccgacaggaaatacatatgaggtgatcaattatattgaaagccttttaaaagaatggaaggtagaaacggttcggaaccacaagggcggcttaattgcaacgcttccaggacgcgacacatcccggcatcgcatgctgacagcgcacgttgacaccctcggcgctatggtgaaggagattaaagcggacggccggctgaaaatcgacttaatcggcgggttccgctacaactcgattgagggggagtattgccaaattgaaaccgcctcgggaaaaacgtacacaggcaccattttaatgcatcaaacgtctgtgcacgtatacaaagacgcgggaaaggctgagcggaatcaagagaatatggagatccgcctagatgaaccagttcactgccggaaagatacggaggagctgggcattggtgtcggagattttgtgtcgtttgatccccgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggggctatcggtgacgggcaggcgactgatgaatattcagtatcaatctgtgtgaaggatgcgagcgggccgtatcattatcagctcagaaagcatttagttcaattagccgagaagcatcatatcgactataagcttgatatatatccgtactacgggtctgatgcgtcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggctgggaaggtgatgacgggttgggagaacagctgattcagcagatccttgccggagaaaaaaccgccacgtgcgcgccgaaatcattgtattcaaaagatgaattgagggacgtttatcaaacagcgggtcagcttgttaccgtttatgataaacatgacaatccaagatgcaatataaaagtaacagatgtctttgaaaccacctttggtgcgcctgatatgaggttagtcaaaggagagggcaatggagaccgaattgaggagtttcaagaggatcatcggatggcatgggcggaactgatccaaagcggtgaactggagctgaatgaggatactgttttgattacagagctgtttgtgcttgttaaagattaaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggcacggcagccatccctttggatgtcaccattaagacgagcacaagcgtaatttggtgccaaatcgtcaaatcaatgccatatacctgtgctaaaaagagtgcggcaatagattgatagagaacggaaccgtctaagttaaacgtgtaaccgatcggaatgacaaatgaaacaatgccttttggacatccgattttctccattttttccatgatgcgcggaagaaccgtttcagagctggacgtactgaacgccagtaagatttcgtccttcatgtaagcaaggaacttgaagatgctgatgccggcaatttttgcgacaatcccgaaaataacaattaagaagaaagcaagcgcgacataaaccaatccgacgagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgatcgcggaaatacccaatgcaaatagtactgtaaagcagatgatggctagaagatccccttcgaccaatgactggaagaagtttgtcggcacaatatggaggaacgtttccgccactgatttattactttgttctttttcagtttcaacatattgactgatgtccgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagattacctcccaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcgtaaggcgcgggattttcgctcattacaaatcgtttacttttatacagtcattgcagatattaccatagcactcatgctgctcttctatcttttttccgcattccgcacactttttcgaaggcaggtttctaaaaaattctgtgattttccccagcataaccaatccctctttcccctttgtagtgatttcattgtaatataacagattgcaaaaatcaataactgttttgatacaatgtttaaaacatgcttttttcaagaaaaatgggtatattgaaggaggatcaatttttttgaaaagataggaggacattatgaaagttacagttatcggatgctatggcggttttccggccgcaaatgaagcgacgtcaggctatttgtttcagtcaggtgattactctctgcttgttgattgcggcagtgccgttttgtctaagctgttcggatatgtgccggcggaaaagctggatgcggtcgttctgtctcattatcaccatgaccatatcgctgatatcgggccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgctgactgccggtccgtttacgatcacctttttaaaaacgattcatccggtgacgtgctatgccatgcggattactgacggcagccacactgtcgtttatactgctgattccagctatcaggattcatttataccgttttcgaaagatgctgatttattgatctcggaatgcaatttttatgccgatcaagacggaacaagtgcaggccatatgaacagcctggaagccgggcgcattgcaaaagaagcgggagcgggagaactgctgctgacacatttgccgcattttggcgtgcatgacaatcttcgcaaagaagcgaaaaccgtttttaacggtgaagtgaatattgcgaaatcaggttttgtgtgggaaggataaaggaggagcaccatgttatttatagacaatcaaaatatcaatgatccgcggatcaatcttgctatcgaggagtactgtgtcaagcatttagaccctgaacagcaatatttgctcttttatgtgaatcaaccgtctattatcattgggaaaaaccaaaatacaatagaagaaatcaatacaaaatatgttgaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggagttgaagccgaattaagcggccggaacgacattgtagtggatggccggaaaatatccggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtagcaaacatcagtgagtttctcgatgataaaatgaccaccgaagaattccgcagccatttgcttcgccatatttttaacacaaacgacattggaaacgtgccggagtataagctgacggaaaaagattgggagaccattcatcaaatttcgaaagagcgctatcagaattgggattggaactacggccgctcgccgaaatttaaccttaatcattcgaaacgttatccggttggatcgatcgatttgcgcctagaggtcaagaaaggcaaaatcgaggactgcaaaatcttcggagatttcttcggtgtcggtgatgtatctgaaattgaaaacctgctggtcggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcgggcaaagacttgtctctttattccaagataatcctgatcattccatcagagcgatggtcagaaaagaagaacagaaagcgtctcttgaagctgccggtgcagaagctgtgcttgcgaatctggagggcagcccggaagaaatcgccgctgcggcaaaaggctgtgacgcgatcattttcacagccggttccggcggcagcacaggctatgataaaacgctgctggtggatcttgatggagcggcaaaagccattgaagctgcggacattgccggaatcaaacggtttattatggtcagcgccctgcaagcccatcaccgtgaaaattggaatgaggcactcaagccttattatgtggccaagcattatgctgataaaattctggaagcgagcggtttaacctatacgattatccgtccgggaggccttcgcaatgagcctggaacgggaactgtttcagcagcgaaggatctggagcggggatttatttcccgtgatgacgtggcaaaagcggtcattgcctctttagatgagaagaatacggaaaatcgggcctttgatctgacagaaggagatacgccgattgccgaagcattgaagaaactatgacagtactgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatttagctttgctgcttggcaattcgcctgattttatcatcgcgttttttggcgctttaaaagctgggatcgtagttgttcccatcaatccgttgtacacgccgacagaaattggttatatgctgacaaatggcgatgtaaaggcaatcgtgggcgttagccagcttttgccgctttatgagagcatgcatgaatcgctgccaaaggttgagctcgtcattttatgccagacggggaggccgagccggaagctgcggacccagaggtcaggatgaaaatgacaacgtttgcaaaaatattgcggccgacatctgccgctaaacaaaaccaagaacctgtacctgatgataccgcggttattttatatacgtcaggaacgactggaaaaccgaaaggcgcgatgctgacacatcagaatttgtacagcaatgccaacgatgtcgcaggctatttgggaatggatgagagggacaatgtggtctgcgctcttcccatgtttcacgtgttttgtttaaccgtctgtatgaatgcaccgctgatgagcggcgcaactgtattgattgagcctcaattcagtccggcatctgtttttaagcttgttaagcagcagcaggcgaccatttttgccggtgtgcctacaatgtataactacttgtttcagcatgaaaacggaaagaaagatgatttttcttcgatccggctgtgcatttcgggaggcgcgtccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccactcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtggaggaggtgctgtacagccatccggacgtcaaggaggcggttgtcatcggcgtgccggacccccaaagcggggaagcggtaaagggatatgtagtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataaaacgaaaaagcgaagcggttagcttcgctttttcattttcaatcctttgcttcttttttaataatatttagcagcgcctttgtatcatttttgctcaatttgtagtatgtgccatccttcgaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgctataaacacaagaccgattaccacgatggctgccactatttttttcatttgcatcactccaaacattgttagttttcccagcgatcgggttttccatgcttaaaaggatggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattctgcaataccggaagccgtgaaagggacgcaggctgatccggcttctttcatgaagccgtctgagttggcagtggccgagcagtattcgaatgtcaagaattttttattttttatcggggtaccacttgattggtttctgttttttgttctgctggtcagcggtgtttcaaagaaaatcaagaaatggatggaagcggccgtgccttttcgctttttgcagaccgttggttttgtgtttgtgctttcgctgattacaacattggtgacgctgcctttagattggataggctatcaagtatcgcttgactataacatttccacacagactacggccagctgggctaaggatcaggttatcagcttttggatcagctttccaatctttacgctttgcgttctcgtattttattggctgatcaaaaggcatgaaaaaaaatggtggttatacgcctggctgttaacagtgccgttttcgctgtttctgttttttattcagccggtcattatcgatcctttatacaatgatttttatccgctgaaaaacaaagagcttgaaagcaaaattttagagctggcagatgaagccaatattccggctgaccatgtatatgaagtgaacatgtcagaaaaaacaaatgcgctgaatgcctatgttacaggaatcggggccaacaaacggattgtattgtgggatacgacgctgaacaaacttgacgattcagaaattctgtttattatgggccacgaaatgggccattatgtcatgaagcacgtttacatcggtctggctggctatttgctcgtgtcgctcgccggattttatgtcattgataagctttacaagcggacggttcgcctaacccgcagcatgtttcatttagaagggcggcatgatcttgcggcacttccgctgttattgcttttgttttctgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccgtcgatcatggaacggattcaacatgcggaaaaagaagagaatgcgccggaacatcaggatgctgacaaataaaaagaagcaggtatggaggaacctgcttctttttactattattgtgcagctgcttgtacgttgattaacccttttccatagtagaaagagtttccaagatatgttgcagtgctttctaaacgatcacggacttgcgcgtttgtccaagtcgggtgcttagaaagaattaacgctgctgctccggcaacgtgaggagtcgccatggacgtgccgttgtaagcaccgtaagtgcctccaggaagtgtgctttggatggatacgccaggagccatcacatcaagctcggaacctgcgcttgagaatgaagctctttggttgctgctgtttaccgcacctaccgcaatagtagaaggatattttgcagggtagccgactgtgcttgagcttccggacgaaccttcgtttccggcagcagcagcaacgacgataccgctggaaacggctttatcaacgactgttttcagcgctgtagaaccagtaggtccgccaaggctcatgttgataacatccatattgttggaaatggcccactcaatgccgttaataatccagctatattggccgcttcctgttgaatcaagcacttttactgcatataatgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcaataacagctacttttacgttagagcctgtatagccttgagagtgaagagccggcgctttaatttgagaaatgccataaggaacagattgcgcatattcatgtgcaatatgatcttcttccacatatgcaacgctcggatcttttttcaattcttttacagctttttcatccaatgttgctgcggccgcgttaacatacttaaattgcttttgaacctttccgcctttttcagaaataacatcctttttcttggcggaactcatggcactcattgtctgcttaaatccgacaatatatttcttttctgtactgctttttccggcagcctgcgcagacatgttgctgaacgccatcgtaaagattaacgttaacgcaaacaacaagctgatccacaattttttgcttctcactctttaccctctccttttaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtccctgcaaattcctgtcgaaaaaattcgttcaaatgacctgcatatgcttccgtgagaacaatggatattatcgtgatattttttcaaagcatgatgataaaagtattctgaaaaataaactttacagaaaagggatagaataaaaaaattattgagagggaggaagaaatgagatgaacattcgccaagcaaagacatcagatgcagcagccctcgcgccgctgtttaaccaatatcgggaattttatagacaggcatccgatttgcaaggggcggaggcttttttgaaagctcgtttgaaaaatcacgagtctgttattttgatagcagaagaaaatggagaattcataggctttacccagctctatccaacgttttcttctgtgtcaatgaaaaggatctacatattaaatgacttatttgtcgttcctcatgcgcgtacaaagggagccggcggccggctgctttctgccgcaaaggattatgcagaggaaaacggggcaaaatgtttaacgcttcagactgagcaccacaaccggaaggcaagaagcttgtatgagcaaaacggctatgaagaggataccggatttgtccattattctctcaatgtgccggcgaagtgaaagctgtggcttgatgatttggttttttgaacgttcttcggttacgatataaatgaaaaggagtgtgccgaatgtcaacgttatttcaagcattgcaggctgaaaaaaatgccgatgatgtttcagtccatgtgaaaaccatatcaacagaggatttgccgaaggatggtgtcctgattaaagttgcttattccggcatcaattacaaagatggtctggccggaaaagcaggaggcaatattgtcagagagtatccgcttattttaggcatcgatgctgcgggtacggtcgtctcttccaatgatccgcgttttgcggagggggatgaggtgatcgcgacaagctatgagctcggtgtctcacgtgatggcggattaagtgaatacgcttcggtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagttacaggagcaaccggcggagtcggcggaattgcggtatcgatgctgaacaagcggggctatgatgttgtggcaagcaccggaaaccgggaggcggctgattatttgaaacagctcggtgcaagcgaagtaattagcagggaagatgtctatgacggaacgcttaaggcgctgtccaagcagcaatggcagggagcggttgatccagtcggcggaaaacagcttgcctcgcttttaagcaaaattcaatacggcggatctgtcgcagtgagcggcttaaccggcggaggagaagttccggcaacggtgtatccttttattcttcgcggagtaagcctgctcggaatcgattcagtatactgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaggatcagcttgcagagaatgttatttttctgcaagcttttttgtggacaggatgatcagctgctgaactgctgtgtcgcgaaacaagattttcatgtaagcggaactttctcttctcatttaaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaacataaagtggcggtaacacatgatttagggaagacaaatgtgcccgagcatccgaagcgggttgttgttcttgagcttggttttattgatacactgcttgatctcggcattacgcctgtcggggttgccgatgacaacaaagcgaagcagctgatcaacaaggatgtgctgaagaaaattgacggctacacatctgtcggcactcgctcacagccaagcatggaaaagattgcttcattaaaacccgatttaattattgctgacacgacccggcataagaaggtgtacgatcagctgaaaaaaatagcgccgacgattgcgcttaataatttaaatgctgattatcaggatacaattgacgcttcgcttacgattgcaaaagcagtcggcaaggagaaggaaatggagaaaaagctgacggcgcatgaagaaaagcttagcgagacaaagcagaaaatcagcgcgaacagccagtccgtgcttttgatcggaaatacaaatgatacgataatggccagggatgaaaacttctttacatcgagacttttaacacaggtcggctatcgatatgcaatcagtacgtcaggcaatagcgattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggaccgtgcggtgtggtctttgcgccgcagtgtagacggggcgaatgccattttggacgagcttcaaaaagagatgccggctgctaagaaataaaagaaaagacaggcaaacgcctgtctttttcttatttgataaagccggataagtggctgttgatattatagtcttttatccgccatttttcttctgcaaattcaatgttgctgaggcaagcgttgacgaggcgcgtgctttgaagctccgggtcaccgcccgatatttccgtcagcagtgcgtgaattgccgcaccgtgcgccacgatcagtaccttctggtttgggtacgcctggttcacttttgccaaaccgcccatcagcctgtcagtgagttcttctaacgtttccatattcggatagatgttatccggatagcgctttgtccgttcctccagcggcatgccctccgcgtcgccgtaatcgcgttccttaaaatcatccatctcgacaatcggaagatgcaaatattcattaataatttccgcggttcttttcgctcttttcagcgggctcgtcacaataatatcccaagaaaagtcctttacatattctccggtttctcttgcttggcgttcacctgttgcgtttagcggaatatcggtttttccttggcatttttgctgcaggttccaatcggtttctccatgtcttactaagcaaacggctgtcataaaatccccttcctgactttattcatatcgctattatactaaatcgaaagcgtgcatcctataaaaaagcctatgcaagaacttcaaataataaagccagcccaattccgccgccgcttccgatggctgcaacagcatattgacagtctgtccgtcttttcgcttcataaaacaatctggttaccagagctgcacctgatgcaccgtatggatggccaagagctaatgcgccgccgcgcacattgatttttgaaaagggaatgccgagttcttgcgagcagacacaaattttgacggcaaaggcttcgttgatttcaaataaaccgatatcatcaggtgttacatcgtgtgtatgtaagagattacggatcgcatcaaccggtgccgcgggcggatagttggggtgaatcccgctgactgcgctgccgataaaccggagcacaggcttaagtcccagggctgccgctttttcttcttccattactaaaagagccgctgctccgtctgctatgccgctgctgttggctgctgtgactgttccggagctggtgtcgaaaaccggctttgcgcggggaataatcgcttttatcggacgtgttttcaaaaatgcttcgtctgtctccaattcccgagaggaacaatttcttcacggtaaaatcctccatcatgcgcgttcctgctgcgttgatggctgagaagcgcgtactcatcctgcatgtttctgctgatggaatagcgtgctgccgtatattctgctgcgatgcccatgtcgggatcgccgatggcatctggagaaaagcgggcccgttctgaaaaaggggattggctgctgctttctgagccgcccgcgatatacaccgtgccggctcccgcttgaataaggctgcaggcatagcgcacagcttcaaggccggagccgcactgtctgtcaattgtcattccgggaaccgataaaggcagtccggcttgaagggctgacagtctggcgaggttgccgcctctgccggtagcatttccgagaataacctcgtcaatttgatcctctagctttcggctgagacagcggatgatgggagccgccaaatcctccggcaggaagggcttcagcagtccgttttgatttccaaagatcgttcgctttgcatcaacaataaccgcattcaattatactgtacaccctcttccagccattttttcacgctggaacgggcaatttttccgctgctcgtttccggcaagctgtctgcaaacacccattttttcgggattttgtaggaggctaatttctgtttacaccagactttcagtgttctggcattagcgtttccaagaatgacagctacagcgatttctccccaatactcgtcgggaattccaacgacagccacgttttcaacctctgggcaggcgagaagcacacgttcaatttcttctgggaaaatatttaatcctccgtacacgatcatcccgttttctcttcctgatatgtatagaaagccatcctcatcaacatagcccatatcatccactgttatccattcatctggtgtgctgccgttaacatagccggaaaaacgcatcgggcttttgacaaatatttttccgatttcccctggctggcagcgttctcctccagcgttgcggatttcgatccggacattatgaaaagggcggcccgctgaatgaggcttccgtttgctgtcttccggtgaagaaaacgtaacaaaacttagctctgatgtgccgtaaaaatcgtacagcttgagatgaggccatgcagcggcaagcttctccttggattctgccggccagtctgcgccggatgaaatgattttgacgggactgtcgggaaaaccctcaatccttgtgagggcgtctgtcatcgtcggtacggtatagagaacgctgatggattcacggcacagccattccttcgctttggcaggagaaaactttttcagcaaacaaacggttcctccgagaaacaaagtgctgacagccccatataggaagtgagaggacattaacgttccgggaatcagaaccttatcatctgatgaaatcgaaaaatctgttcctgtacaggtaaagctctctatccatgagcggtgagatcgcgtaaaggccttcggttttcctgtcgagcccgacgtaaatcccatataaaaagggtgctccggatcaatggtaggcaagggatcagcggctgcttcagaaatatctgccatacagttatccagcaatacaacaggtgtctggctatctgtcagtttgtttttaaaaaaggctaaagtaaccacaagatctgcattgcttatggacagccgctccttacattcagccgggctccagcgtgtgtcgatgggaatggctgtgcatccagccgctgcggctccggcaaacagctgtaaaaacgccagactatttgggagcaggatcgccacacgattcggcaagctcggctgtgacctcagccaatttgcggtttgaaagacaagacgagcccaatcctggtacgtgatttgctccgattcagtctggatcgccacacgcccgggcgatgtttcggcggtagatgaataggtatgagtaattgtcatgtagtgtcatcctccttttgtaaacatcgtatcagaaagagacaaggcttgagtgatttttatcgccagaaatgcagatgcagccgcttttatcaaatcaccaggcacatatgcaaggctcatgaaggcggcctgtgacaaatcaatatgcatgataaaagcttgtaccggtataccaagcagataaataaagatgatgccgaatacgatatgagtgaaaaagagacgcaatactgtcaccttccgcagcctgttagcggctaaactgatcagccatgaagcgaggggataagcaatcaaaaagcctgcgctcggtccgaaaaacacaccaaaaccgcctcgtccgccgggcaacagcggcgctccgaaggcgacgagcagcaaaaagacaagctggcttaagaaagcagactttggcctgaggatactgcctgccaacatgacaccaagcgtttgcaatgtaatcggaacgggtgtaaaggataagaagagagggggcataaagccgagcactgccatcagtgcggtgaaaatcgcaatatgcatcatgtcgattaatttcagcatgtgaaatcctccaaacagtaatcaaatatggttatacaataaatgcaggtaattatcatgtcaaccaatttttaattttggtttacataatgaacacagaaaaaccggccgtatggcagaccggtttttgatggttattcttctgtcaggatgacaagcgaatcaacggaagcggccacatgggaaacggcgcggctgacttcctgaagccctccaagaaaggcttgcagatcgacgtcgatttttcctgattgctctttgctgattttcatgctgtggacgatttcatcgaataagcggttaatttgcgtcattttttctttactttcgctgactagctcatttacgtctttgatatgcttcgatacaatgttgatttgtgtattcgtattgttcacaagctcagaaacagtagagacggtttttttcgtgtcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtaccggctttggatgcttgagaaatgccttcagatttgtccacaagctcttgaactgacctgcttgtttctgaaaacagattggcaatcgatccagaggtttcttgaattttctgatgaagaaggtttttcttttcttcttgttcatcacgggtctggttgtactcgctttgaaacgcttcaaggacaagctgctgttctaagttcaagatttttgttgttgctttaatggcttttagcagttcttgctgatttgtaatagacgcttcataaatgtcaatcattgacaaaagaagctcttgaaacgcacccatataccattttggcaaaaggccgatttttaaatggatggaggcgattcggttacgcttttcaatgaattcatcatcgataacgcctgcaaacatttcctgaatatgccgttttaacgtttgttttaagcggtcaactgagctgtgatcattaatgatatccatcaatgagctttcatggtcaaggtttttataaaacgcatcgacgatgtatacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagggaaacatgaatgaagctgcagatgaaaaatatttgaaaaaccgttcattaaaatgaacggtttaatcgagatctatttgttttaatggtttaatggccggaccctctacaacttcgccagatggcttaaagcgtgatccgtggcacggacaatcccacgtatgctcactgtcgttccactcgacctcgcagcctaaatgggtacaagtcgtatcaacgagatggaggcagcctgtctcatcccgaaatgctcccgctcgcctgccgtttatggtgacggctttcccttctcctggcgaaatgtcttcaaattggacatcaggcttttcaagctttcctttaatcaaatgcttggcgacatcggcattgtaggaaatcactttctgcaacccgggattcagatggaaacgggacggagtgaaaatgctttcgtatggattgtcttttttctccacaaggtctgacaatagagtggctgcgactgctgaggacgtcatgccccattttttgaacccggtcgctactagaatattgtcctcattttccgacatcggcccgataaacgggattttgtcgatcgtcactagatcttgggtggaccaataatatggaatgctttcgatgccgatggtgctttcggccagttgtcttagtgtttcataatgtgtagacatgtcttttccctggcctgttttatggcttactccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggccgcctttttgaacaatttgctccagaagcgcttttaagtattgaagcgggtgaaattgagcttgattcttcatgacaagcgccagcttagaacctaagggaattggaaggtccttgataaggtctctttcaattccgagctttgtgtatgcctcatgctcggtgcggattttttgaacagcgttttcatttgccgtataaagatatgcgtcttgctcgatccattcgcaatcaatttgatgttcatccacaatgccttttatgtaatcaattgcgttttggtttgcttcataataaagcctcgcatggtttaatccgaaatggcggataaattcgtcgtatatcatgtcgtgctgtgcggtaactttagcagttgtatgcgcagtggttccgttaagaacctgatttgcttcaatcaaaacgacacggaagcctctcttcgtaagttcatatgccgttgtgattcccgtaatcccgcctccgataatggtgatgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcggaattggacgcgctgtatcagtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatctattgatatattggttaacaatgcagctgagcagcatgtccagcccagcattgaaaaaatcaccagccaccagctgatcagaaccttccaaacaaacattttttccatgttttacttaacaaaggcagtgctgcctcatttaaaaaaagggagctctattattaataccgcttctattaccgcctataaaggcaataaaacgctgatcgattattcagcgacaaaaggcgcgatcgttacgtttacaaggtccctttcccaatcgcttgttcagcagggcatacgggtcaatgcagtggcaccgggtcccatttggacaccgcttatcccggccagctttgccgcaaaagacgtggaagtgtttggttcagacgtgccgatggaacgcccgggacagccggtcgaagtggcgccaagctatctataccttgccagcgacgattccacatacgtcacaggacagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatccccccaatgccttttttatagtatatggataacggtcgaaaaaatcaataaatttttataatttttagacaactaatacttggcaatctatcgacatatcctgcaaaatgccgtaaaccggaaagtcttatgaaagtaaaatcggtttattactagtaatttagtaccattaaatatcattaaaagatgattttatcttaaatgttaaaaaaacctgtcgttttataaaaacagatgatagattattagtataaattttgcagaaaaaggatggaggccataatatgagtcagaaaacagacgcacctttagaatcgtatgaagtgaacggcgcaacaattgcagtgctgccagaagaaatagacggcaaaatctgttccaaaattattgaaaaagattgcgtgttttatgtcaacatgaagccgctgcaaattgtcgacagaagctgccgattttttggatcaagctatgcgggaagaaaagcaggaacttatgaagtgacaaaaatttcacacaagccgccaatcatggtggacccttcgaaccaaatctttttattccctacactttcttcgacaagaccccaatgcggctggatttcccatgtgcatgtaaaagaattcaaagcgactgaattcgacgatacggaagtgacgttttccaatgggaaaacgatggagctgccgatctcttataattcgttcgagaaccaggtatatcgaacagcgtggcttagaaccaaattccaagacagaatcgaccaccgcgtgccgaaaaggcaggaatttatgctgtacccgaaggaagagcggacgaagatgatttatgattttattttgcgtgagctcggggagcggtattagaaaatagaaaggagctgacccacagggcagctcctttcataaacctatgccgtcggaattcctccggtgattccatatacctgagatgtcacatagcttgaattctctgaagccagaaatacataaacatcggccaattccactggctgtccagcgcgatttaatggagctggcggcgtggcttgtccgaatttcgggatgttttccgtcggctgtccgccggaaatttgcagcggtgtccaaattggtccgggcgcaactgaatttactctgatgcctttggaagcaagctgttttcccagtccgacggtaaagccgataatggcgtttttcgttgctgcgtaatctaacagcatcgggcttggattatagccttcaactgaggtagttgtgataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgcctagttcgtgatgcgactgtttgactagatcttggcaaaaggattcgtcgctcaagtctccggggatcagcactgcttttcggccttctgcttcaatcagctcttttacctcttcagcatctggctgttcctcgggcaagtagttaatggccacatcggcaccttctctggcataagcaatcgcggcagcgcggccgataccggaatcgccgcccgtgacaagcgcttttcgacccgttagtttacctgatcctttgtagcttttttctccgcaatcagggacaggcttcatgttcttttgcaggcctggcggttcttgatattgttcgggaaattcatcatgaaaaaatgcttttataggattcgtaagatttgaatcagacatcagcaacgctccttttctgtttggtgtacattcgtatgtgtacccctgagcataaggagaaaaacatgttttggcagtttgaacactgaaggaccaaagaaaacaagaaaaaacaaacccttcttccatatttatcttgtcaaataagactatatgaattatgataaattcgagctataaatcaactaaatattgggtattggggagtgaatcgtcatgaaaaaagcggcggcggttttgctgtcactcggtctcgttttcggtttttcatacggagctgaccatgtggcggaagccaaaacaaaggtgaaggtctataagaactgcaaggagctaaacaaagtatacaaaggcggagtggcccgcacatcgaaggtgaaaaacaaaggcggaaaaacgaagtacaagccttacgtctctaaggcgctttatgatgccaataaaaataaagaccgcgataaagatcttatcgcctgtgaacgttaaacaagaaaaagcaatctgatgaccagattgctttttctattgcttaggccgcttgatcggccgcagcgcttttcgccttccttgtcataaggctgactgccatcatgaccgtgatattcaaaagcagggcaacgatgcctacattcaagtcttttgcggcttgcggcagagccggaaataaagtgccgatcgtcgtttccgtcattgtaatataagtaactgctccgacacctgcaataatgccggcgaaggctccttgctttgtcaccatattatgcttgaacaggctgaacaaaagggcggggaatagctgtgtgacaaggctgtagcccatcaaaagcaacgtaacgatggtattcccgcctttgaaggtaaaatacaccgaaatcaacgcaatcaccggcactaaaaacttagcaagagccgatacctgttgttctgtcgtgcggggcgcaattaccttgtacacattttttgcaaacagcgtggaggcggacattaagatcatagaccctggcacaagtgctgtcagcagtccggcagcaccgataattccgacaaaccaagggtcaaatgcttgcagagacagtttcaaaagcgacaaatccccgtctgcgcctttcagatctggaacttgcaggatagccgcgaagccgacgaaaaggacgaagagcaggaccagctggtacaaaggcatgatgatggcgtttttacgaaacacttttgggttttcggctgaatacgaagcggaaaacgtgtgaggccacatgtaaaaaccaagcgctgtcaagagtacggttgaactgaaccaggccacactttgtcccgattcgggagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcagcggtcggggtgattttgccgtacgaggtttccgatacaatcagcccgaggcctttcagctgcagtacaagatagggaatgagtgcggcgatgccgaccagtgaaacgagaatgccaagcagcggactgttgtatttttttgtgaaaaaatcagactgcgacatcagtttatgctgtttcgcgtacgtccaaactgctggaagaagccagtaagaaaggatgtaggccagacatccgtaggcgatgatataaaaggctggaccgccttttccgtaggcccagccgctgccgccgagaaacgtaaaagtagtataaatttcgcctgccatcaaaaggaagacgaaaacagttccgaagccgcgccctccgaccgtccactgctccaggttcatgtcttttcctttttgggcgcgtataccgagaaaaatactcaagagcaggacaccgaagatgatgatgagagctgcattcattctgcttcctcctttttattttccttgtcgaggacatacacaatcgccatcagcgcagaggtcaaaagagcccacatcacaatataggcaagaataaacggcatgccgaacacatagggggtcaccttatttgcaaaagggatgccgagtaagattccgataaagggcaaagcggcaagaacgtgaatcagtttcatagaatcctccttctatttaggattggggtgtacaagcctaagcgtaatgaaaatgatgtcgcagatatggcagcacatgtcactttttagggtgaaaggctgtggttcgaattataaataaatttattttgtttgtatagtgtgaattgtctgaaattaatgatctgaatcgcccgaagagggaacgggcagtatgattcaaaaggctcggagtctgtctggggcaaatagatagtatgttaataattcgctgacctgctcacggattcgcggattaaaatagcgatggttttcttcataaccgtcgatgacaaatgtatagagtgtaaaggcctcatcgcgttccgtctcgcggattgcaatttttcttttcctcagttcttttctgacctccatcaaatccttttgtgctatttttaatgattcgctgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatgttgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcattgctgtgctgctgcctttaattgaagcatttctcccgtttttgccgctgatcgtgtttgtggtggcgaatacgaactcgtttggcttgtgggaaggattcatcctgtcctgggcgggatcaactgctggttccattctcgtctttttgattgtccgtcaatacggacagagaaaattgcttggatttatccgcagtcatccgtctgtcagaaagctgatgttatgggtggaaaggcacggcttcggtcccatgtttcttctgctttgttttccatttacaccgtcagccgcagtgaatgttgttgctggtttgtcaaggatcggaacgcggccgtttattttggcggcagcctcggggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgtatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaaatattgtcggtgtgatttctgatgccgaataaaaagacgctaattgaagaggcgtctttttgtatgccgtttggaaaaatgtgttgaagaaaaatttgtaaggagctataatcaatattgttacgcgcgtaacaaaaaaacggttgttttatgattatgggttgtttttattagattttgttcgttttgtatgaaacaaaaggagtggtgaatgatgatgaaatatgaagcagtgattataggaggagggccggtcggatttatgctggcttctgagcttgcgatggccggagtaggaacatgtgtgattgaacggcttgaaaaacctgttccgcattccaaggcgttgacgctgcatccccgaacgctggagcttcttgagatgagagggattttagagcggttcgtatccaagggaagcaagataccttccggacatttttcaatgctggatacccgtctggatttttcaggcttggatacgagctgtccttacacgcttttgctcccgcagtcaaaaacagaaaagctgcttgaagatcatgcacgaagcctgggaacagaggtgtttcggggtgcagaggcgctggcggttacgcaaaacggggaagaggtccaaacaatttttaaggatcgggacggcagtgtacggacaatcacaagcaagtttgccattggtgcagatggcgccggaagtaccgtccggaaacaggcgaaaattgagtttccgggaacagacagcactgtcaccgctgcgcttggggatgtggcgctcctttctccgccgccgtcaggcgtgctgtccctttgcacaaaagagggcggtgttatgattgttccgttatctccagaccgataccgtgtcgttgtgatcagtccttatcgcacgcaaacgccgaaagatgtgcctgtgactgaggaagagctgaaagctgacctcctgcgaatttgcggaactgacttcggtttaaccgacccttcgtggatgtcgcggttcgggaacgccgcgcgccaagcgaaacggtatcgggacggcagaatctttcttgcgggtgatgccgcgcatattcattttccagcgggcgggcaaggactgaatgtcggccttcaggatgcaatgaacctcgggtggaaactggcggcggccatcaaaggctctgcgccttcgtggcttttggacagctaccatgacgagcggcatccggcagcggaagggctcctcagaaacacggaggcgcagacaaagctgatcgatttcactcaagcaggtctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcaaggctccctgacatggagctgattctttccgacggcagttcggaatggctgtacagttttctccaaaacgggacattcgttttgctgtcattgaggcaggaagctgatgatcatatcgaagtgaatggcttacgttcggtaaccgtctcgcttgcagaaccgaatgaaaagttgcgggatgtgcataccatattgattcgtcccgatggacatgtagcctgggcggtggatgcatcagcgcccgattgtgccgaggtgattcaaaaagggatcagacgctggttttccgtcaccagccgagtataattcaattcgattgtttcatctgtaacaaaacggtatgatagaagaaacaatcgaatgaaaaaggatggaagactcgatgaacacagatcatacgaaacgcaatctttttgaattgtatgcggagctcatacatcagcaggagaaatgggaggggcttattaaagtctttttatctgacgaattgaggaagctggatgtagagcacgggagtaaatctcaattgacgatgacagaaattcatgttctatcctgtgtcggggacaatgaaccaattaatgtcacgtcgatagcagaaaaaatgaatacgacaaaagcgactgtatcacgcatcagcacaaaattgctcggcgcaggcttccttcacagaacacagctcagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaaggggggcttcctagcatttttaaataaaaaaacacgcactgcggtgcgtgtttttcacgtttcttctttctttttcaagattgtaacgtaaatcagatttcctccgactaaaatcataagcggcagtccaggggagccggatgtcaccaaattataaatcagccagattcctaaacatattccataatataagtgcattgccttctcgggattgtcgcgcagcaaacttcctttaataatctttttcatcatatcgcccctataaattttaggatttccctttagtttacatgcatcttcggttcatctcaaaatttgctctttggcttttgatgctctcaaaatatttcgagggaattttagaattatttttttacagatatgttttctgatagctctgcccacttctatcatctactatctcccttgctaaaacactgttttctccatataaacaaggaaagaccttctgtagcaagccacctatttagtccttttatttcctcttgggaggaatgtctcactttctatttcggctaatactcccatagaatcaacaaatgtaatacttgtttcattttcacgcataagaattttcgtacccccacttaatagaccctgtcatttctcagctaagtctgttgttaacttgccaatatcttctgcagagatgccgtaccatccaacaattcgttatgaatcaacctattctgaaattggtcagagatctctagaatacccaagtaacttgtgattttactttctaataattggaaccactgatctttttcactcaatgtatcttctatatatataaatttgtacatgtatttacctcaattcattcatttgttttatttttatttgaaaagtaaaaagaggacattaagtcctcttcttacttacgatatgtctattagtatctttcatttacacgtgtttttgatgctttgttttcaaatgaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaagcaataaataaacttgtaacttcgtcaacgtacttctgaataatgattgatgctagtgttaaagcaatgggaaatatgcccgctatacttaggccaatcaaaaatgtaccactcaattgaagtaatgggttacttatataagagaaagcaatcaacaaaacaattaaacaactacagctaaaaaggaggtatttagaaaaatcaagccttctacttacgaaaccaatcaatattcttcctatgatgatccctacccagaaaaaggagacacttataagactaatttgttcattgtcttggtttatcatgattgaaggtaaaaagttggcaaaatttgtttcaattccagcatataggaaagcgaaaaatacaaaaaagcctaattgctttgatttttttctatctcctataaagtattgaaatgctcctccatctggaaaggtcacttgttggttagcattcttagcgtactctcggttcttagacaagaaaattaaccaccctacgaataggacgaataaaaaggtgaatatacagtaatacggtaaaaaccagttattgatatctatgaaggaattaattaataatgggaaagataaagcgcctaatccaaagagaacttccagcttactcattttttctgcattactttcgaaattagcaataacaaatgaaccaactgtcgtttctaatgtgcctgccccatatcctaagagaaaagccattacaacaatataataccaatccttagttagaaaaaagatacttaacgctacaagcattattgtcaaagctaaagtaagtgtcctaaaatgactgtatttcttaatcattaacggtgcgattaatactccgcttagaaatccggtaaactgaaagaagattatgaccgaaatatcatctgttgtcttgttaaaagcctctaatagaaatggtgtcaaactccctgttgatatatggataatacctactgtaaaaaagaaagcatatccgaataaatatgtccctcttaacattcattacacccctatatgaaaaagcaggaaagtaaattcctgcttttttagtaacttctctctttgaaatactagttgactgctgaaacagacattggttgagagttgctgtctttctcaaagaacatttctaacacttcctgagatctaaaaccatcactaaaagaagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtgcagaacattttgatgtgatgatatttacaaataccttgttcttcagctggccataaatttctgcatagtcatctactagtacctgtttatcctcttttgtttttacatttgtgttcatctttgcccttactgattctgtgatgaaatcactctcaaacaaataccataccatgtcgataaggtgaatacccagatcccccaatgaaccactcgtcttcctactgttagcgtcatctctccaagtaaatttcttgcgtctaagtgcactatttttcttgaagtgtacttttatggacaggatgttacctagttcattattgataattaagctttttaagatatttacgtaagataaatatctataattaaatcccatactggctcttacgctcaacctttcagcagtatctttcattatgcttgcttcttcaagagaaatagccataggcttttcacacaaaacatgcttatgttttcctaatgcttgcaaagcatgttctttatggcaaaagtttggtgatgctacaattaaaccttctgaggcatcaattagttcatctacgttttcaaatgacttcccgccgaaagttttcacaaagctttccgcattttgttgatttatgtcatatacccctactaactctgcattttttattgtagataaagcagttgcatgcgctcttgcaataccacctgcacctatgatgccgatcttcttcatttttatttcctcctcatgatccaattaatttttttaaggtattagtaattccttttgagtactcactatcagttataaggtggtgcaagtttttggcttcctgtgttgcatttttgagcagatatccattccctactgtctgtagcatacgaacatcatttccactatccccaaatgcgatagctctttcggtatttaggttgtatttctctaacataaacgttacaatttcattctttcctgtccctgtggggataaaatctacatcatagctgtcttctggatcgcctgctaagggattacaccgatttatatttactgaaacgccgtattcctcgcagattttttcaattgctaataggtttttcttgtcgtttatttcatcttgttcctgatagtagaagttatgcttataccgtgactttcctaattgagtttgaggattcaaaagaatgttatgattttcatgtagctgtttcacaagtttttcaaccttttctttactaaacccatcatttatgcgactgttccacttattatcttgctgaccgaagttatgctctgaaaagtacgtaatttcagttccaagatcactagctataaaatgcggaaaatatctaaattttcctcgtcccattttatcgataatagattctatactgctcccagtaacccatccgattattagttccccatctttacttttttgttctagatagtcttcgagttcataaatgtcttgttgtttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaattggagtcctgcatacttgtcctgtactaaaggagttttttgcatatgagacagtattggataatatacatctgtttgaacaccaaaatcttcatttaatttagtcatgatatctgctctatcttctgttctcaccttaataggaaacagatgccatacatgatcttcacttaattctggtaattcaataaagcctttattctgcaactctgctaattgggtaatgtatctatccgccaagaacagtcttttgaagttgtttaatgaaaggtacttcattctctctaaaccaattgctgcctgtaaattgtccatttttgaattaaatccaaaattgatgactttcttatttttcacatttacttcaaaaccatgataactaaattgaatgcattttttagcgagttcttcattatcagttgctattgccccagccttgccacatacaccaaaattcttatagggattaaaacttaatgtagtgatgtctgcatactttcctaagtctgtcagtccaattccttggcaggcatcttcaattactttcaatttataacgatttgcgatttgtcggatatgctgcatgtctgaatgttttccgtataaatgcacaggtagaataaactttgtataaggagttattgcttcttcaattttgtcaggatcgatgcagaatgtttgtgggttaatatctacatagataggaacgcctcccaaagctaacacagcattttcagtagctgaaaagctattagccggcatgataacttcatcccctgggtttaaccctaaagccaataaacctatcataatagcatcggttccactgctggttgcaattacataccttttatgtaaatatgtagataaaactttttcgaattgctctaaatagggaccactcgtaaattttccagttggcaaaacttcagttaatgtatttaagatatcttccacttcatcattggttattaatctgtctacaggcaaaaaagggactttactgatttcacgatttttttgatagttgaaaagatcatgttcaatatctatcttttcctttaatacttgtttccactgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctaatttctgaaatcggtaacatgtcaacaacttttttaaggaagggaaaatatgcctacaattgatgaaatagcaaaattatgcaatgtgtctaaaaccacagtgtcaagagtattgaataatcatccttatgtgtcgaaagaaaaaagagatatgatcttaaaggctattaacgaacttgactacactcccaattatttagctcggaattttaggagaaataagacacaaacgatagctttatcggttccgagtatcgaccatccattttttgctcaattaataaaaggggtctctcatgaagcactgtttaagaattacaaggtaattgtatttcagaccttttatgacaaacagacagagctagaattattagagttattgaaacataaagaagtggatggtattattcttggaactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttacttgaaagctttacaagattacaatttacatcatagaagcgaatggatattcggcgaaatgtttaatattgaggatggctttcgtgtttttcataagataaaggatctaaaggacagaccctcagcaatatttacaggaaatgatcaagtcgccgcagggattattaaacaggcgatgaaaaatggctttaaagttccagaagacttagctgtaattggttttgacaaccaattgatctgccaagttgttactccgaccataacaacaattgatattcccgtaatagaattaggccaacaggctgtgttgaaaatcatcgagtccatttcgggtaatgcctctttaaacagaagaattattaaactgccaacaaagcttattataagagaatcaacgtaacgatagatttccctttatcattttatatctttatataagaaaaagaggttattcattttaacctctttttcaatagtaagtcgtcaattatttctttcatttcaccctctggcagcactcacttcaaatctgatccattaacaacgaaatatccacttatatttccccatctcgatggtttgcgaattaaaagttcttgaacccttttttcaactaggcattactgccgctgatcgagctctttttgtcttttttttcaccatgaagatggtgaagcaggcgataaaacggcggcagcagggcaataaccagaatgacgcgaatgacctgaaccgcaacgacaaaggtggaatcagcatgtaaggtaactgacgtcgtcgccatctctgcaatcccgccgggcgcaaatgccagaacagaagtgatgagcgaaattcctgtcagctcggaaacgatcacggcgctcaaaaacattgctgcgatcaaaccgacggacgagacaaacccgacgatgataatacgggtgacgccggcaaacatgcttttgtacatcttagagccgatcgttgccccgagaaatacttgtgatacatggttagcttgtgacggccaccatgccgtcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaatcgtctctgctgcggcacttgcggtacgatcttgttttgtatagatcagaatgactaaaaacggaatggaaagcaccacgagcagcacacgcatcatttgaacgaggctgactatagcggtattggcgcctacttcctgtgcgatgctcggcatggcggaaagtccgccgggagcggtgccgacaaagctagtcatcatatccgttttgctgaaacgccaaagcacatatcctgacagcatagccagcaggatagacaatatcagcataacgccgactgaaaaccaatggtctttgagaacagagagaacggataaattcagcttttggcccaattcgatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaacccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcacttttcttatgaccttgtgttcgagcttttctattgtgtaagtcagagataaacccgctgtcagcagacacacggcaagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcatcaccgctgccgtcactaaaagcattgtcagggaggttgagcatgcaaaaccggcagccgcaagggagtagcaaatataagtaatgaagaggatcgttttcattgaaagcttttcggtccctttgacaagaggtacttggagaacacagctgaataaagcttttgctgctgaatagatggtcagcatggacagataatcagaaaacatgtttttgctgaacagcctgtatgttgtttctgtttgtgcatataacatgctgatggggagagaaagcagcaaaagaagcaggacaggcctgtatatcgtaaagctcgcggacattttcggggtaacagctgggtgtagcggctttgtctcaggcagtttcagtgcagcgatcagaaagtagataaacaatgctgcggcatctaatgcgaatatccacacggggttatgattgtacagcagcatccccactagcggccctgccgtcagtcccgccgaatagatcgcattgatgaccgcaaacacttccgaacgtctgctttccggcgtgctttcggcgatttgggcgcgggaagcgggaatgtacaacgatcttccgatgccattcatgacatagagaatagcgaaaacatacgcatgctcagcaaatacaaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactggtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatgggcaaatgaacgaaatgacgctcactgagattgctaactgtttattttgtacagaaagaaatgcaaagctcattttacataagctggagaacaacaattggattatccgggaaagcggggcggggcgcggccgtaaatctaaaatcgcgtttcttcggaggcctgaggaattgcttcttcaaactgccaaggaatataccatgtcaggaaagcttaaaaaggcaaaggagctgcttcagcagtatcagtccgtgtttccagggcttcaaaacgaatataacatgtggctttcagaggtgttcggatttgtgacggagacgggcgagaatgggacgaaggatgttctgcggctgttcatctcgcctgaatctgtcagcagtttggatccatgccaaatatttttgcggtctgagggccatttcgtcaaacagatatttgatacactcttgacgtttgattcggatatacaggagctgaagcctcatttggttcatggatgggaagaggtcgaaaaaaaacaatggagattttttcttcgaaaaggtgtgtcatttcataatggacagccgctgacatcgcgggacgttgcgtttacgttttagcgctttttggaactgggtgacaacccgtataaatggcttctgcacggagtgaaacaagtcttagaaaagggcccttattgtgtggagctcatactcgataagccgaatgcgcttttgccgtatgctctttgtgatgaacggctgtccatactgccggcagaacagggcggcgggaaaaatggaacagggccttttcaggtgaatcagcaacacagcgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtttttgatgagcggcatgttcagtatttgtcgcttaatctgaaaaagaaggggcctcttcagcaccgaagctttagaaaagcgctccggctgctgatttcctctgaacggctcgttcgtgaagcgggagggcaccgaagaatcccggttacgtcctttttgcatccgagtccttttgagtgggagggcgtttcgccatctgaattgttgaagaaaagcggatacgagggcgaaacaatcgtgctttataccttttcggaaacggatcatcgtgaggacgccgaatggattcaaaatatttgcgcccagcacggtatcaggcttacacttcaattctgtgattctgctgatctgcgacggccggaaatcgtgcagatggcggatatcattcatgacagtgcgacgttttatcaagacagcgagcttggttttctgcatttgctgctgtcggagaacagtttcttgtatcagcatctatctgaaaagctgacacagatatgctcaggaatgacggagcagatgttttccatgcctgaccgctgttcgagaatcgacatcctgcgtgacattgaccggcagatgatacaggagctgaatgcgattccgctgtatcaaaatgtgctccaggtgacatcaagtaaaaatgtaaaaggcctggtgcttgatgaagagggatggattgatttgtactccgtatggctgtccaaataaaaagagggttcttttttgaaccctcatttttacgctgccatgctgcggcattgttcagcacaggcgaagcaggctttcgcacatgcttggcaatgatcatgatcgtgctttccgcattcagtgccgcatgcttcacaaatatcggcgcaaagtgcacaaatttctttcataaacgggctgtccgtttgcatggctttgaccgccagcgcgcaaatatccgcgcattccctgtcaagccggatgcatccgctgagatgatgctgcatgctttcttccaagcatttagtaaaacaatgattgcaagccttcatacaatcgatgcaagcctcaatacaagcttcagaatattgctccatggttgattccccctgtatgacagtatatggttttatgtttcccggctgcatttgaaaaaaacaggggagtgtgtttttagctgaggtgatatgtacatataccctgaacgggtatatctaacgttccatcagatagtataggaaccagacagcgtgattttgttcatcacgtgctgcgcgtgtaaagacgcctttcgcttttaagtttgacgtttcctcggccgcacgcaagtaaaagtcgacggtttcttgttcatctttaaaagcggcgtccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcaagcttgcggtagcattgaattgcactgaattctccgttgatggccttctgcaaattccgaatcaaaacaggatcttccctgtatggcaccggatagggataatagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcaatagcattcaggatgaattgcgccgggctccattcgggaagccgatcatttttctagtcccggatcaaatgacgtttttaatggaatacgagcttgctaaaacgccagatatgggcgggatgatacgcgctcaagtgttcagtttttcacgattggcctggcgcgtcctccagcatacgggaggaatgagcaggccgtttctgacgagcaccggcgtacaaatgctcctgcggaagctcattgaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgtgttttatctgaaaagctccatgacttatcaattctgtatcagcaaatggaaaaaagcctcgcagaccaatatcttcattctgaggattatttgacattgctggcagagcatatcccgcttgcggaagatataaaaggcgcccatatctatgtggatggcttttatcagtttacaccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatctggacattacgtataaagagctgagcgggactgagcggcatacaaagacgccggaattggcgcatctagaggcacagtatgaagcgcgtccggccgttccatacgcagaaaaacaagaagcccttactgtgatgcaggccgcaaacagacgagctgagctggaaggcattgcccgggaaattcacgccctagtcagagagaagggatatcgctataaggatgtagcaattcttgcgcgccagccggaagactacaaggatatggtgaaggaagttttcgcagattacgagattccttatttcattgacggaaaagcatctatgctgaaccatccgttaattgaatttatccggtcaagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcgtttccaatacaggcgttttgtgtcattggatgatgattttgcacagactgatcaggaaatcgaaatggaaaacatgttgaatgacacccacgattggattgttccgccgctttttcagcttcaaaaacgcatgaaaaaagcgaagacggttcaagagaaggcagaggcgctctatcgttatttagaagagacagatgtgccgctgaagctggatcaggaaaggcagcgtgctgaggatgacggcagaatcattgaagcgcagcagcatcagcaggcgtgggacgcagtcattcagctgcttgaggagtttgttgaaatgatgggagatgatgagatttctcttgatttgtttcagcaaatgatagaagccggcgcggagtcgcttacattttctcttattccgcctgcgcttgaccaggtgtttgtcggcaatatggatttgtccagaatgtatggcacctcctgcacctttgtgctcggggcaaacgacggcgttctgccggcacgccctgatgaaaatggggtcctgtcggatgatgaccgggaatggctgaaaacgattggggttgagctatcctcaggcggacgggagcgtttgcttgatgaacatttcctcatctacatggcgttttcaagtccgtctgaccggctttacgtatcgtatccgattgctgatgcagaaggaaaaacgcttttgccgtcgatgatcgttaagcggctggaagaactgtttccatatcataaggagcgcctgttaacaaatgaacctgaacaggtcagcgatgaggaacagctgatgtatgtcgtgaataaaagcgtggcacagtcctttaccgcgagccagctcaggttatggactcgggaatacgacatcagcgacgtctggtggagcacgtacaatgtgctgatgagtgagccggacaagctgcaatcgaaaaagctgttctcaagcctgtttttccggaatgaagtgaagcagcttgaacgcagcgtgtcgagacagctctatggtgaacgcattcagggcagtgtctcaagaatggaaacctttaacgcatgcccgttttcccattttgcgtcacacgggctgcatctgaaggaacggcaattcttcaagcttgaagcaccggatatcggccagctgtttcattccagcttaaagctgatttcagacaggctgcgtgagaaaaagctggattggcgcgatttaacgaaagagcaatgcgagctgttttcctatgatgcggtagagcggctggcaccgaaactgcaaaaggaaattctgctcagctcaaaccggcattattatgtgaaggaaaaactgcaaaaaattgtgacacgtgtatccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggatctcttagatcagactcggccgcagtcggtgaaaaggaatttgatcttttgacaaagcatgtgcgccgcaccttccaggaagcgggcgaacaaatcaccgacggacgcgtatccattgagccttacaaaatgaagaacaagacgccgtgcacatactgtgcgttcaaatcagtatgccaatttgatgaatcactggaagaaaacgagtatcgcccattaaaggctgaaaaggacaagacgatacttgagtggataaaaaaggaggcggatggcaatgaacattcctaaaccggcagacagcacatggacatatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatatcagacgccagctttctcttttgaaccgggccagcatttcgacgctccattccttttgcctgcaagtgctgaagaaatattactacttgatcgatcttgacccgggctttcggatagctgatcagacggaaggtgagctactgggggatgaagtgcttgacgagctgtttgaagacgaatacgcaaagggcgaaaaggcgttttttgagcttgttgatcgctatacgacagaccggcatgatctggatctgcaatttctcgttaaacaggtgtacgagtattcccgatcccatcccaacccggaggcgtggctggaaagttttgttcatttgtatgatgtatcagaaaagagcgccatcgaggagctgccgttttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgcgcagattgatgaactgattcagcatcaggatgatttcattgaactatataagcgggtgcccgccgtctcttttaagcgtgccaaagcagtaaaaggggatgagttcgatccagcgctccttgatgaggcgacagatttgagaaacggcgcaaaaaaactgcttgaaaagctcaaaaccgactacttcacgcgaagtcctgaacagcacttgaaaagcctagccgagatgaagcctgtcattgaaacgctcgtacagcttgtcatcagctatggaaaacgattcgaagctgcgaaacaggaaaaatcaatcatcgatttttctgatttggagcattactgtttagcgattttgacagctgagaatgacaaaggtgaacgtgagccgagcgaggctgcaaggttttatcaggaacagtttcatgaggtgctcgttgacgaatatcaggataccaacctcgtgcaggaatcgattctgcagctcgtcacaagcgggccggaggagactggtaacctgtttatggtaggagatgtcaaacagtcgatttatcgattcaggcttgcggagccgcttcttttcctctctaaatacaaacggtttacagagagcggagaaggcacggggcggaaaatcgatttgaataaaaatttccgaagccgggctgatattttagacagcacaaactttttatttaaacagctgatgggcggcaaaatcggtgaggtcgattatgacgagcaggctgagctgaagcttggtgcagcgtatccggacaatgaagagacggaaacagagctgctgctgatcgacaacgcagaagatacggatgcaagcgaggaagcagaagagcttgaaacggtgcagtttgaggcaaaagccatcgctaaggaaattcgcaagctgatttcatcgccatttaaggtgtatgacggaaaaaagaaaacacatcgcaatattcaataccgagatatcgtgattttgctccgttcgatgccgtgggctccgcaaatcatggaggagctgagagcacagggcatacctgtttacgccaatttaacgtcaggctattttgaagcggtcgaagtcgccgtcgcgctttctgtgctgaaggtgattgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggaacgatgagctttatcaaaagctaaatacgttttacggacatctgcaaaaatggcgcgcgttttcgaaaaaccactcagtatctgagctgatttgggaagtgtaccgcgacaccaaatatatggattatgtcggcgggatgccgggcggaaaacagcgccaggccaatttgcgtgttctttatgatagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgcagcgggtctcggccggaatttcaacatgatggatttaaataaatcgtacctgctggacaaggagctcgggttcggcacgaagtatattcatccgcaattacgcatcagctatccgacacttccgctcattgcgatgaagaaaaaaatgcgcagggagctgctgtcagaggaattgcgtgttctctatgttgcattaacgagagcgaaggaaaagctgtttctgattggctcatgtaaggatcatcagaaacagcttgcaaaatggcaggcatccgcgtcccaaactgattggcttctgccagaatttgaccgctatcaggcgaaaacgtatctagatttcatcgggccggctcttgccaggcacagagacttggaggatttggctggtgtgccagcacacgctgacatctcagatcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacatacccgcatcacgaggtgacgcaaattcggacaaagcaatcggtttctgagatcaaaagaaaaagagagtacgaggatgaatacagcggcagggcccctgtaaagccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcataggctttatgaaaaagagcttctcactgaagaacaaaaagacgctattgatatagaagaaatcgtgcaatttttccatacagaaatcggcggacagctgatcggtgctaagtggaaggaccgggaaataccattcagcttagcgcttccggccaaggagatctatcctgatgcacaggaggcagatgagccgcttttagtgcagggtatcattgactgtctctatgaaactgaggacggattatatctattggattataagtcggaccggattgagggcaaattccagcatggatttgaaggagcggtcccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccataagctccggaatttcaggcggagcgggtctcgttttctatataaaagagaggtgaaagcatttgcggattttacatacggctgactggcatcttggaaaaacgcttgaaggaagaagcaggcttagtgaacaggccgatgtgctggatgaaatgaatacgattgtaaaggatgagcagatcgatgccattgtaatggcgggggatgcatttgacaccgtaaacccgccggctttagccgagcagctgttttatgaaagcctgtctgcgcttagcgacagaggaaagcgcccgatcgtagtcattgccggaaaccacgataatcctgaccgtttgtcagccgcttcaccgctgacacatgaaaacggcattcatttaatcggttatccgacaacagagccgattcatattgaagtgccttcagcaggagagcttttggcggttggagcgctggcgtacccatctgaagcgcggttaaatgaagtgctatccgatacgtttgatgaaaagctgctccgtgatcattatgacgtgaaaatcaggcaggcgtttgaacatatgacaagccggttccggaacgatgcagtgaagattgccgcaagccatatttatgtggcaggcggaaaccaaaccgattcagagcggccgattgaagtcggcggtgcatacacggtggctgctgaaagcctgccggcagatgccgcttacgtggcgcttggccatttgcatcgcccgcaaacgatcaagcgggcgcggacgcttgcgcgttattcaggatctccgctcgcctacagcttttctgaagcgggctacgcaaaatcagtgacgattgtggacgcaaagcctggggaagaggccacttggcaagaggtgttattatcaagcggcaagccccttgtgaagtggaaagcggcaaatggattaagtgaggtgtacagctggctggatgaaggcagagatcagaatgcttggattgacctggaaatccgtgtcacagaccagctgtcacttgaagagattcacaggctgcggaaggcgcacccaggctttatccatatcaggccggtttttgaagaacagaacaaagaccgggaacggatcgaggttaaacatgtctcaatcgaggaccgctttaagaaattttatgaaaaacaaactggcggtgcggtgccggatgaagaaatggtgaagctgtttttagagcttgcatcaggcgttgaagaggaggatgcgaaatgaagccgatcgctttaagcattaaggggctccacagctttagagaggagcagacgatagattttgaaggcctttccggtgccggtgttttcggcattttcggcccgacaggaagcggtaaatcctctatactcgacgcaatgacgcttgctttatacggaaaggtggaacgggcggcgaataatacgcacggtatcttaaaccaggcggaagatacgctgtctgtttcctttacctttgcgcttcagacgaatcaccaaatctcatacaaagtcgagcgtgtgtttaagagaacggatgaaatgaaggtaaaaacggcactttgccgcttcatcgaaatcaaggatgagcataccgtactggctgataaagccagcgaagtgaataaaagagttgaggagctcttggggctgacgatcgacgattttacgagagcggtggtgctgccccaagggaagtttgctgaatttctgtctttaaaaggagcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtcttggtgaggcgagttcagaggcagttgagcaggctgaaaaggctctcgaacaagcggaagcccggctggaagcgatgaggaagaaccgtgatcaggcgaaggagcggtttacagagcatcaggagatatggaatgtccaaaaggaaaaatccgcttatgaagaagaggaaaaacgtctcgcagaagaacagccgcatatagacagcatgcaaaaacgcctgctggaagcagaaacagcagcagcccttaagccctatgcggaccggtacgcagaagcgatccagcatgaggagcaagctgaaaaggaacaaacgctagcccaaaaggatttagcagaccggacagctttctttcagcaaaaacatgaagagtatgaagcgtggcgccagcataaaagcgagaaagagcctgagcttttatccaaacaggaacagctttcacgcttgcaggaaatcgaaatcaaactgagtgaggccaagcaagaggaagagcgcaaaaaggctgacctccggcagaaagaagaggctcttcaatctgtcatgaatgaattggagaccgtaacagaccgcctgacacgagggcaaaacagacagacagaattgaagcagcagctcaaatccctgcaggtgacatccgatgagcgaaaaagctgccagcaggccgcagaaatggcattgcgcatcagacaaaccgaggagcaaatcaaaaaagagaaaaacgaagtgacgaattgaacctcgtgcttcagaagatcaatgaagagaagaatacactcgttcaaaagacggaagcggaagaaaacaacatcattcaggcatatgaggcagttcaaactgtgtaccatttggtgtgcgaaacggaacgctcattaacacgtatgacggaagagactagaaagagccaacacacgcttcacttacagcgtgaaaaagcaagggtggcactgctgacaaaagagttagcccaaaagctgactgccggtaagccttgcccggtatgcggttcaaccgatcatgatccatctgcctcagtacatgaaacatatgaagccgacagccatcttgaagaggacattaaacagacagatgtattattgacggaagctgcagctctcagccaggagattctttcagccaaaattacgcttgaagaacagtccgcgcgctttattgaacagtgtccgtttttgcagacaattcaagcgcagaaccttgaagcggcagcttccttcgaacatcagccggtgtatgaagcatttgaaactgccaaatttgaatggaaacgaatcaagcaggacattctttctgttaagacacgaatggcacaaatgatcggcgcctatcaggagtctttaaaaaaggccgagcagcttaatgaaaaaatcggttttgaaaaaagagaagctgaccgtattgaaagcatcatcaccgagcttcaatcctcaatggacagcagtctgaacatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaatcgagacaccggcttgagcgggaaaagctggagcttcattatgcggctgaacgcataaagagcgtgatagctgattatgagcacgaactcggagattatgcaaaaggagattcgattcaaatcaaactccgctctgtccagcaggatctaaagctgttaaaggaaaaagaacaatctttatatgaagaactgcaaagtgcccaaatgaagctcaaccaggcgaaaagccgcgcttctgcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaaaaagctgaggacgcatttggcgctgctatagaggaaaaaggcgcggcagcaaaagcactggctgtcattcgcgaccatcataaacggtttaatgaaattgaagctgaactgaaaaaatggcagacgcatatcgacaggctggacaagctgcaagctgtgtttaaaggcaataccttcgtcgaatttttagctgaggagcagcttgaaagcgttgcgagggacgcctcagcaagactcagtatgctgacaagacagcgctatgccatcgaagtggattcagaaggcggcttcgtgatgcgggatgacgcgaatggaggcgtaagacgcccggtttccagtttgtctggaggagagaccttcctcacctcgctttcacttgctcttgcgctgtctgcgcagatccagcttcgcggggaatacccgcttcagttctttttcttagatgaaggcttcggcacactggatcaagatctgcttgatacggttgtcacggccttggaaaaacttcagtcagacaatctggctgtcggtgtcatcagccatgtgcaggagctgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcgatgtccagctgacagagcatcatctcacaccgaaagaggaaggcggagcgtttttgccgacagcgatgctctgtattccttgccataaacagattcatgccttatataccaatcaagagctcgctttacgtttaaacggaatggctgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcattatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgattctcgcatcaccgcggataagcgaagctgaaccagcatgtaaaacagaagaggcggaaaccccttgaattttgatgctgcgaacataaatagccggcacctcgtggcaaaatgcgctttgtacacctgtttcgcgaatcggcttcactgcctgctgctgaaagatttggtactcctttttgttaaatgagccttcattattgtaaaacgtggaccgagaacgctgaacagcaaatacttttacactcatatcgatttcatttgtgtcgccaacttgaaacacacttgcgatcccgagggaattaaacttaactagtctgatgcgtgatatgcgtttaagcattattctggcgcaatcggagcaaacggcccgatgataagagattcaggcggtgtatcaaaaatagaagacaggtagatggattcagtgtctccgatgtggaaaacggaggaactggacacaccgttcatccggatgtccccgacttccaagctgcggttgatgactgtaaagatcatgcttgctcatctcctttcatttctgatggaatatgctccagaaagtgttctacagcgcggatgacatcacgcttcacatgttcagcgatatgttctgcatattgtgcaggcggtgtattttcttcttttttgatatgggacatataatagtgaatccggctgtccatttgttttctgatgtcttcaataacatggtgtctgtttgtatcgtcaagtctgctgtcatattggttttcaagctgttccaaaatatctgggatttcctcagttaagtacatgtcgacattctggcggatctgctgcatgagctgagcgctctcttcctgctgcatcatcccgatttgcggtgtcgactggctgacttcaaagttttggacgctgttcgggtcagtcggatttaagccgatattcaaagtcccgtcgagcctttcgattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttcttcacctctttcatatgattaacggccaggaggctggagcgggaccaatgaacctgtgtcgggctcctgcagctggagcggttgccctgagccataaacttctggtgccggttctacataactccctgtattatacaaatttgacagtgacttgattgatccggcgctcccgatttgcagaatggaggaattactgattgattccagccggagatagttgatttgaatggtttgattaatatagaagttcatgtgcctcactccttttacgcattggccacgatcggctgatcaaccgcatcattgtcatacacattcgtcgcgttttgataattcatcaccttgaggctgtcgccggtattaaagctgccagcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattaaaaaaagacaggtaaagtgaaataacaattctgatttcaattgggctattcacgatagcttatgacaaacgcacatatgtgtgagagaaatttaaaggggacatatcggctcttgatgaaagcgttttattttttcgggccgttatgtttaaacatggcaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatcccagaagtgctgagcaaaaagcggagttacatgtggtgtattctaagtgttatagaaaatgatttacatacgggagttttcaagatatctcccaaaaatcatttcttctttaatccgggtattcagcaggatatccagctcttggctgcattgaatcgtttcttttgaattcatgccatatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgtttgtctgctccttttcgatctgaaaggggctttttttgataaaaggatcatcagcagcactttgacaaatgtcaaggtgccattcgttgatgagaggagataatcgttcaatagtaaacgaccgcttcagcacgtttttcattaatgtgtgatattgcgaccggaaggcgggaatggatagaagccttgacgaaagcgtctttccttttgtcagaagcgggtcttcgtcataccattcttgtacggcaagcgatcttgtctctatcggggaaacgtaaagccggccggattcgtttaaacaaaatgtgtagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgaggaatcactgttaaaaagggacaacggaacccttggatcggccgtcttcactccgtaactcgttttactggctggctgatggttcttgatgttcaaataaatgccttcaggctggccattgatggtcagaaagctgtacgaggcagcgggagcaggtacgccgatctggtcaaaaaaacaataggcgagtctgcgccgcatcagggacggatcatcctgttctgcattcaaaaaaagtgtcctttcaccaagcagagacttttcccagctgatttcgtaggatgccttttccgctctgtcacgctgtgtgagaagaatgggagaaacagatcgatctgttacgaaaagccccttggcagtacctttccttttcagctgctcccgatgaaaaaataaatgcacgcgctccatattctttcctccttctcaaaacgacatttgtatgatatgtagagcaagcccgtcctgaaacgaaatgaaaacggaattgagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcaaaaggctgaaaaaaaactgtttgaacttgagacgattccaggatcgctgattgaatgtatcgcagaaggggataaattcgttgcgcatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctctcagcttgattatgagggagaacttgctgtcgtgatcggaaaaagcgggactcgcatttcaaaagaagatgcatatgaccatgttttcggatatacgattgtgaatgatatcacggcgcgtgatctgcaaaaaaggcataagcagttttttatcggaaaaagcttggatacgacatgtccgatggggcccgtgcttgtacataaatcatctattcaggagccagagcgcctcaaggttgaaacaagagtcaacggcgagctgcgccaatccggttcggcaagcgatatgatcttttccattccggaattaattgaaaccctctcaaaggggatgacgcttgaagcgggcgacattattgccaccggtacgccgtctggtgtcggcaaggggtttacgcctccaaaattcttgcggtcaggtgacaaaattgatattacaattgatccgatcggaacgctgtcaaaccaaattggctgaataaaactggagggcggacccggacccgcccgttttttctgataatcatctttgtgacagaggacaagttcatggtactataagtggggtaatttatctgatagggggaacatatatgacacacctacatattacgacatgggtggtagcgctgattctgcttttcgtcagctactcgctgtattcgtcaggaagtgcaaagggcgcaaaaatcactcatatgattctgcggttattctatatccttattattttgacaggagctgagctgtttgtccgtttcgccaactggaacggagaatacgccggcaaaatgattctgggcattatcaccatcggcttgatggaaatgctcctcatccgcaagaaaaaagaaaaatcaacaggaggcctgtgggtcggcttcgtcattgtccttttgctgacagtgctgctcggtctgcatctgccaattggttttcaattgttttaatagaaaaacctatgaacccggctcattgatagagttgggtttttttatatttatccccttatattccaaatcatttaaaataaccttaaaattccctgtaagcggtatctcgtcctttgaaattatgataccttcaaggagattcattattttgcaggagggataacatgaaacgcagaaaattcagctcgtttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaacactcacatatggcactgaccgtaaagagtgattcagtactgaatgtatctgtatatccaagtaaggaaaaagcgcttaaagatgaaacgtttgagatgtaccgttctttcacagcggaggatggaaaaagcgaagtcatttttccatacgcgtggagcggcccttactatgtaaaagttgaatacctcggagaagaagaaccagaggacggcggaacaacagaagcagttgcagaagccaagtatacgatcgggtataaaggcaccaaaaaacagccgtcagatttagaagaggaagaagcttgcccggttgaaatgagtgtcgatcagaagaaatcaggaaaaggcatcctggataaattgagagcgattcgtgatgagcagctgagccaaacagcagaaggcaaagaactgacaagcctttattacaaagcagcaccgtttatcgttgcaaagctcgcactcaataaaacagcaagaaatgaaatctatcaggatcttgtgacattaaagccgttatttgacgatgtgtcagaaaacggagcatcatcttcgtataagatcactgaaaaggatcaaaaagcgatcaaccggctatatgataaagctttacaatcagtcccgtcattccttaaagaggagataaagaaacaagcggaccgactaaatatgaagcagctgcaaggcaaaacagccggagccattttaacagaaaacaatattgcagcaaaaagtgaagttcagacaacaaaggttattttcaaggtgaaggacaataaaagcctctcatccgtacataatgaaatgaagggcttttctgcaagcgcgcaatcgaaaaaagacatatctaatgtgaaaaaggcaaagaaactgtttgacaatctgtattcatttgaacttccgaaagacgagaaacagaacggcgcatatacggcaagcgccaaaagggtcaaaagcgctgctgcgacactatccaagatgtccaatgtagagtttgcggaacccgtgcaggaatacaaaagcctggcaaacgatattcagtacccttatcaatggccgcttaaaaacaacggtgaaaacggcggtgtcaaaaacgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacgaaataacaatgcaatggatgatcaggggcatgggacgcatgtcgcaggcattattgcggcccaaagcgataacggctattcaatgactggattgaatgccaaagcaaaaatcatccctgtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcggctgacaaaaatgttttgattgccgcagccagcgggaatgatggagaaaatgccttatcttatcctgcatcttctaaatatgtgatgtcagtcggcgcaacgaaccgcatggatatgaccgctgatttctctaactatggaaaaggtctggacatctctgctccagggtctgatatcccgagcttagtgccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgatatttcctttgaaagtgtcgatggcggagaagaagagttgtatgacgattatggcgatccgattgaaattccgaagacacctggtgtagactggcattcaggctacgggcggctgaatgtcatgaaggctgtcagcgcagctgatttacagcttaaggtcaacaagctggaaagcactcaaacagctgtcagagggaacgcgaaggaaggcacacttatcgaggtgatgaacggcaaaaagaaactcggcagcgccaaagccggaaaagacaatgcgttcaaggttaatatcgcgactcaaaaacaggatcaagtactgtatgtgaaagcaacaaaaggcgatgcgaaaacatcgtataaagttgttgtcgtcaaaggaaaaccttccggcacaccgaaagtaaacgcggtgaaaacgaaggatacggcagtaaaagggaaggcaaacagcaaagcgatgatcagagtgaaaaacaaatcaaagaaggtcattgcttctgccaaagctgacgcaaaaggaacgttttcggtgaaaatcaaaaaacaaaaagccggaacggtgctgtacgtcacggctgcggatacggataaaaaagaaagcaaggaagcaaaagttgttgttgaaaagtaaccaaaaagcggtgctcgatgcaccgcttttttatttgcgcccccgttggactgctgaatacataatggatcgctttccgtttgaagccgtccattcaaaacggtctcctgtcccttcgctgctgtagtgatgctgcatcgcgcattgtgcggtgtcatttgaaaagtgataaaaggacacaccctgccccgccgaagtattcgaaaagactcctttattataagaaaagacgcaatcgaataccgataagccgaagctgtgcaagtgctgtagaaatgcgagaaaggtttcgtcgtcaagcgaatccaaaagcgccatgagcggccgcttgactgatttctcatagcggatgcgttctccgccggaaagggggatgttttctgcaccgcatgccaaaaccaacttgtcctgaaagccggcttgctcccactttcctttatgatggatccagattgggctgtgttggagactgtccgccagcagtatatcaccttctccgttttcgattaaacagatgccgtcttcgatgaggatggtgccgtattcccattttcgttcccctgtatatatcaattgtttccgtttcatccatgctgtctcctttttcttcattcctctcttttctttccaattcaagcctgtcccatacaactcttttatggacaaatcaactatctgcctatagatgcataaacttactaaggtgctgaaagaaacgaaattgttacgaaagaaacgggattggagctgatgtcacatgtgtggaattacgggttgggtcgattttaaaaagcagctcgtccaggaaaaacaaacgatggacagaatgacagacactctttccaaacgagggcctgatgattcaaacgtttgggggagcaccatgttttattcggacataaaagacttgcggttgttgatattgaaggcggacgccagccgatggcgtgtacctataaaggggatacgtacaccattatttacaatggcgagctttataacacggaagatttgcgcaaagaattgcgggcgcggggccatcaattcgagcgtacgtcagataccgaggtgcttctgcacagctacatcgagtggcaggaagactgtgtcgaccatctcaatggcatattcgctttcgctgtgtgggatgaaaagcgtaatctgctgtttgccgcgagagaccgtctcggcgtaaagccgtttttttacacgaaggaaggctcttcatttctcttcgggtcggaaatcaaagcaatcctcgcgcaccctgatataaaagcgcgagtggacagaacgggactttctgaaattttcggtcttggaccgtccagaaccccgggcactggcatatttaaaggtataaaagaaatccgcccggctcacgcgctgacattttccaaagacgggcttaatatttggcgttattggaatgttgaaagcgaaagacatacggacagttttgatgacacggttgccaatgtcagatcattgtttcaagacgctgtgacacggcagcttgtgtcggatgtgccggtttgtacgttcctatcaggcggtctggactcaagcgcaattacagcgattgcggcgggccattttgaaaaggaaggaaaagcaccgcttcatacttattcgattgattacgaagagaacgataaattttttcaagcaagcgcttttcagccgaatgatgacggaccatggattgaaaaaatgacagaggctttcggcacgacgcaccacaaatgcgtcatcagccaaaaggatctcgttgatcacttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgactcatggcagaaaaaattgaatctgaaagaatacgtaaatgccaaatatgaagaaaccttggcagaaacgccattattagatggtgaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataaccgggaaaaaggcattttgcgcaaagcgcttgagggcattttgcctgatgacattctgtatcgcaaaaaaagcccgtatccgaaaacacaccatccggaatatacaaaaggcgtcagcgaatggctgaaaacgatcagaagccaaaaggactccgtgctccataccttgctggacagaaaacaattagatcagcttttagaaacggaaggctcctccttcaaggtgccgtggttcgggcagctcatgaaggggcctcagctgatcgcccatcttgctcaaattcatacatggtttgaagcgtatcgcattgatattgatgaaggataaagaaaaagccgattctgctcaaaggaatcggctttttcttcatatacaattgcgagaaaacataatagacttgaagaagcagtgatacataggagtgaaaagaaatgaaagagataatagaagcctatcagcaatgcggccagatcgtcagcgcccgcgaaccagcctgttacaaagcattttcgtttcttcctctgaagcaaaggcaggcagcttgggcggttatggcgttttgccatacggcagccaatgcggatgagaaggcgttatctgccattaaagctgaggcggaagatgttttttccggtacgtataacgggaatcattttttgtggaaggctttcggccatgcctaccagacatttacactggacagcgagccattccgtgagttcattgccgcacagaaagcggaagataaaccgtttggaaaccttgatgaattgctcatgcacgcataccagacaggcggggcagccggattgatgctgctcccgattatggcgcgccggcatcagaaacagctgacacttgcagccggttctctcggtttagcgattcagctgattcggattctgagagatatcggcactggccaacagcaaaaaagccgtatccctcgggaagtgatgcagcaacttggatatacagaggacgaccttcaaaagggcgtcgtgaataaggcgttcacaatgacgtgggagtatatcgcttttgaagcagaagcctaccttgaagagtgtcaggatgccttgccgctatttccgcagtattctcaaaaaccggtgaaagccgctcttcttttgcaccgggctgttttagaaaaaatccgggcgaagcagcacgatgtatttcaacatcacttcgctctcacagagaccgaagtgaagcagattctctctgatatctaaaaaaacacccggtcttgattgagccgggtgttacgccatacctttttgaatccagatacgtgagcgccatcttctgtacattaagattccccggacccattcatccgcgataaaagaaatccaaatgccggcaagaccgaaaccgaggtggatgccgaaaagataagcaagcgggagaccgatgccccacattgaaatcattgccatgtaaaccgggaatttcgcatcccccgcggcccgcagagagttaatgataatgacattaaacgagcggcctggttcaaggataatggtcatggcaatcaataggcttgcagttgctataatgtcagggctttgtgtgaagagtccgatcaggtcttttgaaaagatcgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgacaatcatttgcgaaaggttgtatgaaagctgctctcccgcagaaggaatgccgattttcagcagcttgcgcaaatgctctttatgcatatgaaagacttttttcagcgacatcttcagctgaatgcgtttgttgacaatcacaatcatcgcgattaatccgatgacgcgggcgatagatgtggacatggccacaccggcaacgccgagaacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtctgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgccacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgcctcgcatcctgtttacagtcccgccttttccggtatttatcgcagccggggaaggggtttttaaaaaaggagaaacccatgtgaaacgtgtattctccgtgtttgatctgatatatgtcaaacagggaacgttatatataacggaaaatgaaacatcgttttctgttgaaggcggcgagtacatcttgctttctcccggtcttgaacactacgggacgaagggcagtgatgaagcaacctcctactattggcttcacttcgatgaacatcgttatgaatttacgacaaagggaggcagcaactggtctgagcttcagcaggaaaaagggagcttcgaagagccggcccgctacggattggccttgccgagaaaaggcaaggtgcagcgcccgcagtttatggcgcagcagtttgaaaagctgatcgattactccgcggaaaactctgatttgccgctcagaaagcaaatcttatttgaggagctgatgctgcatcttcaaaaagaagcgttccaaataccgtctgcgaaagagcgggtagcctgggaggcggcccggtacttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatacttttcaaaactctttaagcagatagaaggcatttcaccaattgaataccggaaaattgtcagccggaaagttcaataaccagacgagggatgaacatgaaaacaacaatttacgatgtggcaaaggcggcgggtgtctcgatcacaactgtgtcgcgtgtgataaacaatacggggagaatcagcgataaaacacggcagaaggtcatgaatgtcatgaatgaaatggcatacacgcccaatgtccacgccgcggcgttaacgggaaaacgaacgaatatgatcgctcttgtggcgcctgatatttcaaatccgttttacggcgaactggctaaaagcattgaggaaagagcggatgaactcggttttcaaatgttgatttgcagcaccgattacgatccgaaaaaagaaacaaagtatttttctgtgctgaagcagaaaaaggtggatggcattatttttgcaacagggattgaaagccatgacagtatgtctgctttggaggaaatcgccagtgaacaaattccgattgccatgatttctcaggataagccgcttcttccgatggatattgttgtgatagatgacgttcgtggcggatatggggctgccaagcatcttctgtcactcggccatacgaacatcgcctgcattatcggagacgggtcaacgacaggcgaaaaaaatagaatcaaaggcttccgtcaggcgatggaggaagcgggcgtgcccattgatgaatcacttatcatccagacgcgattttccttggaaagcggcaaggaagaagcgggaaaattgctcgacaggaacgctccgactgctatttttgccttcaacgacgtattggcttgtgccgccatacaagctgcgagaataagaggcataaaagtgccggatgatctttctatcattggttttgataatacgatactcgcagaaatggcggctccgcccctgacaaccgtagcccagccgataaaagagatggggaggagcgtcatcgaactgctggcagaagcaatagagggaaaacgaaaggcgaaacaaaaaatagtgctcccgcctgaacttgtagtcagacattctacatcaccgctcaacacatgagcccgctaatgagcgggttttttcattatgacagttgaagccaaaaaacatattgcgtgtaaaccaaaggcagtgtaaaatgaaaccatcttttgagaaagcgcttgcgcaaaatggtaaagcggatagaaccgctgtttttttagctgttaagagaaagcgctttctcgaagcgatcctgaaatgagataaaggagaggatgggacgtggaacatcaagtaagatgtgcagtattgggattaggaaggctcggttattatcatgcgaaaaatctcgtcaccagtgtgccggggcaaagctggttagtgtcggtgatccgttaaaagggagagcagagcaggttgccagagaattcggtatcgaaaaatggtcagaggacccgtatgaagtgttagaagatcccggcattgatgctgtcattatcgtaacgccgacaagcacacatggtgatatgatcatcaaagcagccgagaacggcaaacagatcttcgttgaaaaaccgctgacattaagccttgaggaatcaagagcagtttctgaaaaagtgaaagagacaggtgtcatctgccaagtcggctttatgagacgattcgatcccgcatacgcagatgccaaacggcggatcgacgctggagaaatcggcaaacctatctattataaaggctttacgcgcgaccaaggcgcgcctcccgcagaatttatcaaacacagcggtggaatttttatcgactgttccatccatgattatgatattgcccgttatttgctaggggcggaaatcacttctgtttcaggacacggcaggattctgaacaatccgtttatggagcagtatggcgatgtggatcaggcgctgacgtatattgaatttgactccggcgcagcgggggacgtcgaggcaagcagaacctctccatacggacatgacatccgggcggaggttatcgggacagagggcagtattttcatagggacattgagacatcaacatgtgaccatcctatcggctaaagggagcagttttgatatcattccagactttcaaactcgttttcatgaagcctactgcttggagcttcagcatttcgccgagtgtgtccggaatggaaaaacaccgattgtgactgatattgatgcgacgatcaatttagaagtgggtatcgccgcaaccaattcctttcgaagcggcaggccggtacagctagatgtgaagcgcgcttatacaggtatgtaaaagctaatatgttgcatttgaggctttccgcaaaaaaaagcaaggacattttagcccttgctttctcttttctcatataaatagtacatataatcagtaggtatgcctgaatggcccagctgtctcagcatggcggttacgttccctctatggtaagtcccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactccagaaagaacattgagccaaatgtagtcagccctgcacatatgaagcagcacgtcgctgacagaaggaaatacgctctttacttcttgataggcagtttcctccggcaggttttcgatatgggtaaatattttcttgtttgcccaagaatgatagtcataaaactgttttgcatcagtcatcagtatgcctccttttctaagaaattcgtttttttcatttgtttctccttcaattgcaaaagagtgataccccaaaatatcctgccgctgcccacattaccgctgcagagcatttgtttacgatcagcataatcctgccgctcgtatctatcgtctgaaacaaccggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaacgcaacttgcttttttggtgtgaacgtatgtttctcattttggcttgtgttcggacggctgttccaagtcacccagcccatatagagcaaaaataaaaatccgccggccatcatgactgtctcaaacacaggcagctcctgcacaatgacagatacgcccgcaacggctaatatgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacatttttttcaatcataagagagattgtcactaaagtctccagccatttggttgggttaggaaccagccaaatgtataatgtgtaaaaaagggggcatgaccttgtctcaatggcagccaagccgaaagtcggatgttccgctgcatcggcagatcgaacaatatatgaaagacaagattcttcacggagagtgggctgtagggacgaaaatcccctcacagagaacgctggccgacatgtttcaagtcaaccgcagcacagtcacagcagccatagatgaactcatgtctcaaggcttgttagagggaagaagaggcggcggtacgaaggttgtaaacagtacttggagcgtgctggcggctgagcctccgcttgattggagcgattacgtccgttcgggcattcatcgccccaattcttccatcatccaagctattaatcagaacgaaccaagagcggatatcatcagattaggaacaggagaactatcaccggatctgctgcctgctgacacaatgagccggatgtttcagcaaatcaatccgggcgccctgtctttaggatatgagcagccgaaaggaaatcgtcagctgcgggggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagcggggatgcggcttcgcggcttgccgatggatggtgaaggggtcaaagcggggcttgtttcttcttatcgaaaacaatatggaggacagctgctttacacgattccgtcgtttcataatccgacaggcacagtcatgtcagagcagcgaaggaaagagatcatcagcctgtcaagaaaagagcagctgcccatcattgaggatgatgcgtacggtgatttatggtttgaagaaaaatcgccgcagccgttgaaagcaatggatcatgagggcaatattctgtatctgggcacgttttcaaaaacggttagccccggtctgcgaatcggctggcttgccggtccggagccggttattgaaaggctggcggacattaaaatgcagacagactacggatcaagcggcctgtcccagtgggcggctgccgagtggctgtcacagggatattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgtcagccgtttcttttatggattgctgaaacggcaggtgcttgtgaatcccggctacatttatgacggtgaagaccgaaacagcatcaggctgtcatattcctatgcatctcttggagatttggaaactggcattaaagcggcagctgaaacagcacgccgcctgatgatgtcctaggctttggttatacgatgacagctcccagtgccctggcgaaggcaatcgcgtgctcaggtgcgattttgcagcctttcaatttgtcgagggagacatgaagctgttcaaaacggcacgtgctgatgtccatgttttgaagggacgtgccggtaaagctggcgccttccaattcgcacctgtcaaagtgtgtctgctggagcaccgtattgctgcattcactttgcataagagcacagtgatcaaatcgaacttgtttcatatttgagtacgaaaatgagctgaaatgtccgtggcattcctcgaatgaaacattccgcagcgttgcttccgccacattcattccaaccatttttgactgcttaactgaagttctgtgaatgacagccccgctgaaatcggcgtttgataaatcgcatttttcaaagatcacatcggtcagttcaatatgccgaaaagacacatcgataaagacgacatttctgaataccgttttttccacacagagtctttcgatatcttcgccgcagatggtacaatcttcaaacaaatgcatgctgattacatcatcctgcgtcacggcatcatgaaaatctgcggtttgcaggttttccggtatgttcggtttttgaattgcgattttattcatgtgatgacatcctttgctgcccgaaaaacagaggcttccgggttcaatttaatagatcgttaaggaaattgatacatatagtaaatcgtgaagagccttttcttggtacagcagcccgcttgttttgtaagcataaatggaaagcttcctatacgtcaaggcgtttacaggccgaaaaagccaaagggaacaggaggaatgcagaatggggcattacgtcaaaaccgaggagcatgtgacactgtttgtagaggatattggacatggaaggccgatcatctttttgcacgggtggccgttgaatcataagatgtttgaatatcaaatgaatgagcttccgaaaaggggatttcgttttatcggcgttgatttgcggggatatgggcaatctgaccgcccttgggaaggctacgattatgacacgatggccgatgatgtgaaagcagtcctttatacgctgcagcttgagaatgcgattcttgccggtttttcaatgggcggcgccattgcaatccgttatatggcaaggcatgaaggagccgatgttgataagctgattttactgtctgcagcggcccccgcgtttacaaaacgcccgggttatccgtatgggatgaggaagcaggatattgacgatatgattgaattgttcaaagctgatcggcccaaaacactggctgatttaggggaacagttttttgagaaaaaagtgtctccagagcttaggcagtggtttctcaatctgatgctggaggcttcctcctacgggacgatccactcgggcatcgcattaagagacgaagatctcagaaaggaacttgctgcaatcaaggtgccgacgctgatcctgcacgggagaaaggataaaattgcgccgtttgattttgcgaaagaattgaagcgcggtatcaaacagtcggaattggttccgtttgcaaacagcgggcacggagcattttatgaggaaaaagagaagatcaacagtttaattgcgcagttctccaactcataagaaaaaacccgacattgatcgggttttttatataattcctctgttttgcagtgcgttaatgatgagatcagctccatcggaaatagaggtctggtctgactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagtgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaaggtctttgtttaagccgtggcggatattatcaccgtcaagcacgtagctctgaatgcccttgcggtaaagcttttcatcgacagcattggccagcaccgattttccggagccggacaaacctgtaaaccaaaggacgcagcttttgtgtccgtttaaggactgtctgtcagactttgagatggcagcgggatgccaaatgatgttcggattgtgtgtcattgcaattccccgctgttttgcttgatggcaacaggctgttggtgaagtcccttgatcagcacggctgcgacctcagggcggctgaattctttaggcggctttttgccttggcggagaagctctctcacttttgtgcctgataagtggatgtggtctctcgggctgtgcggacatgttttggaggtgcccatgtttccgcattttcggcaataaaagctgtgctcaaaaaacagcggcttgatgcccagctcttcctctgtgaatgattgaaaaatattttgggcgtcgtatgttccatagtagctgccgacacccgcgtgatcacggcctacaataaaatgggtgcaaccgtaattttttcggacgagcgcatggaaaatcgcttcccgcggacctgcataacgcatggcggcagggaaaaccgataacatgacacgatcctttggataatagtgattaagcaaagcctggtagctctccattctgatatcgcttgggatatcgtctgactttgtttctccgacaagcgggtgaagcagcagaccgtcgaccgtttctaacgctgttttttgaatgtattcatgcgctctgtgaacagggttcctggtttgaaagccgacaatcgttttccagccgagcttttgaaaggccgctcttgtttctgcgggcgttgcataaaactgttcgaaagatttgtcaggcaggcggctgaccgtgataggccctccgatatagtaatccgggcgcgccagcaatttttttacgcctgggtgggcaggatcgtttgttttaaaaacagacagtgcttcttgtgttttatcaggctggtatatatcggtgactgtgatcatgccgtaggtaacaccgtctttcacaagcttgacgtgatctccggcagacagctgtcttgctgttttttctccgacaggcagcgtaatcggcaggctccacggcaagccgtttgccagcctcatttccttcacaacacgatgataatctttttctcccaaaaaacctgttaacgggctgtagccgccgatcgcaataagctccaggtcgctcagtgcaagctgatccagctcagcttggcacgcgcacccttcaaaacggcatgcgtgatcacagcggttgattaatacccctccgtggggttcgtttccattcaacgtgttcaacctccatttatacgtttccttgttttctttgctgcagttaatgaaagtttgacatcagcgcctcaacatcatttcgactctcatagccagaacctgccgtccgctattcttgatgcaggccgcattctgttttctcccgtccggcccatcttccagccctctcatcgttcgggtccggggaaggcaatgtacacatttcacagcctatgctcgggtaatgttgatcgtgcagtttgttataaggcaaattgtgcaggcggatgtacgtccaaacgtcatcccatgtccagtggatgagcgggcaaattttgatgagcgcaaacttctggtccaggtttacgtattgaatatgctttctcgttggcgactgctcccggcgcagtcctgaaatccaagctgtcatgccggacaggtgctttttgagcggttcgattttccgcaattggcagcagaggttcgggttatgcttccacagctctcctccgtacttcgtcccctgttctgttaagctcagctcgggttcgagcatctgaattgcaaatcccggatatcgctctttgacggtctcgatcagctcatatgtttcctgaaaatgaagcccggtatccaaaaagatgatgtgtgcatttttgttgatttttgatattaagtcgagaagcaccattccttctgcgccaaagctgcaggcgtacacaatcttttctccgtacgttcggtaagcccatttcaacacatcgagctcatcgatcaattgatccgttatctgtttggacagcatgtcgttccatgtgtcatatgtgatggtttcgttcaatgttttccccccgtttgcatctgctttttttatctattgatcgagttataggcagactattcattttttgcataaaggttcagggtttttaggggctgcgcccgcctaaaatgaggtgcggaaccattaagagcccggctgaatatgctttttagcaaaatggttttatgcccaaggagaggtagtatgccgattgccatttatcaggggcatcatcattcgcttgccccggctgatattaacatcgtcattgatgtcatcagagcctttacggtcgcccattatgcgtttatcggcggggcgaaagagattttgttggtccggacagctgatgaagcctttgcgctgaaagacgtctatccggattatgtattgacgggagaggaaaagggggtcggtatcagcggatttgatttagataattctccaaagcgcatggctgtgcagaatatggcggataaaagcctgatccagaaaacaacaaacggcgtcacagcagcattgggggcgctgaacgcaaagcatctgttcgtaactggatttaccaatgccaaaacaacggcacagcatgtgaaaaagctcgccgcaaacgattgtgtcataaacattgtggcttcccatccatccggtgatgacgatatggcgtgtgcggagtatatcaaaggcatcattgaagggacaaatgcggtaacggctgcggaggcgattgaaagaataaaacgctcttctgttgcggagaagttttttgacagccgccagccattgtttgatccggaagacatcgtttactgtacaaaagaactgacgggcgatttcgtgatgaaagtgaaacaagatggagaagttccaacgatagagagggtcataatatgaatgatttttcactagaattgccagtgagaacaaacaagccgagagaaaccggacagtccattttaattgataacggctatcccttgcaatttttcaaagatgtcatagccggagcgtccgactatattgattttgtgaaattcggctggggcacctcattacttacgaaagatcttgaagaaaaaatcagcacactgaaagaacatgacattacatttttctttggcggcacactgttcgaaaagtacgtaagccagaaaaaagtgaatgaatttcatcggtactgcacctatttcggctgtgaatatattgagatttcaaacggtacgctcccgatgacaaataaagagaaagcggcttacattgctgatttttctgatgaatttcttgtgctcagtgaggtgggcagcaaggatgcggaattagcaagccggcaaagctctgaggaatggcttgaatatatcgttgaggatatggaagcgggcgcggaaaaagtgattacagaagccagagaaagcggaacgggagggatctgttccagcagcggcgatgtcaggtttcaaattgttgacgatatcatttcctcggatattgatatcaacaggctgatttttgaagcgcctaacaaaatgcttcagcaagggtttattcaaaaaatcgggccgaatgtgaatctggccaatattccatttcatgatgccatcgcgttggaaacgctgcgtttagggctaagatccgataccttttttctgtaaaacagcggctgcggggctctcgtcgtgaagagagcctctgcctattattttttatggcggtacataggcgtgagatagggaagtgaggtcagacggatgttgtagatgaagtcgatgactcttgtcgatatcacttggcatatcagggcttgaatgacaatgccccagtcaataatagacgcggtgaccataaaaatgatgcaattcatgatgagcaggatcgtaccaggattcccgccgcggtagatagaaatcatcagagcaagggctccgaatcctccgttcgaaattttatatttgtataaaagtccgatgccgagtcccaataacactgcgccgcttgccagatcaagccacagattagatgtgatatccggaaaaaccgcatcaaagatcaataccgagacagaggtgacggtgatagaagcgagggtgccggtgaatgttctcatctccagccattttaaagcggtaaaaagcattgatacattcacagcccacactgaaaatccgtgggggatttgaaacagataatgcaatagcaccgcaatacctgctgcaccgcctgtcggaatatcatgcggaaataaaaacaaggacatgccgagtccttgtagtacgccgcctacgacaatcataaacgtaagttttgctttcatcagcagttcagccattaagtcatttgctcctttatgaaaagacttgtccgctgttttcattttatgaggctgtccatgatttatgtctcaaaataaagaaatggcccagcttaatatgctgagccatcccacttgtagcgattgacgatctccttattgatctctgttccaatgccttttcctttcgggatatggaccattccttttgaaggctgcaggctgacgagatctgtaaaaggattctccatgacgtcccactcgatcggttcaatgtgatcgttcttcattttagaccatgggggcagacaggcttgtgcaaataaagcatagagccgtgagagcgatccgtcatatgcatgggcggatgctctgacgccaaaataacgcgcgagctggaggcagtcccgaaactcatcaattccgttgacatgcatgacatcgggctgaatgatatccaaacagcgctgtgaaagaagaggcacatattgcgccgggcctttcatattttctccgccggcaacaggaacagacaaacggcttcgaagcatagcgtaatcctgcggctgatcaaagggcaaaggctcctcaagccagccaatgttcgtccattcggagaaatagcgctcccatttaaaagccgcagcggcatcgtagctttggtttgcgtccagaatcatcgtaatggagctgcctgctgtatgctgcagcgcattgatgtgccggacatcctccttgaatgaagtcccgccaattttgactttgatttgctcaaaaccttttttcaactgggcttcaacattggagactgagcggctgatccattgcggggagtctgagtacgattgaaaagacgcgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccagcctgttttcctaatagaaacgggatgatccgcttcgtaaaaccgacatggagagcagggagccaatcaacgcattctccccagccgtctatcccgctttcggtgataatcctgatgagataacaagtccgatatcgtttaaacccattggcatctccatatggcttttctaatcggtgaaatagcggaaaggtttcaatccgtacaattttcacactgggtgctacctttcctcagcgggctgtagccgatttccagccattttagtgtcttctttttcttttgtttcttcattgttttgcttcacatggatgagcatcatcacaagaatcccgacaacgagagtcaatcccgcgatgcttaaaaacatgccgggtctggaccattgcatcaggcggccgaaaatcggaggaccgatcgctacccctaagaaacgtacagagccgtacagcgaggtgacaaatccccgtctttccttgccgacagccccggtaataaaactgttcacacaaggaaggacaagacctgagcctatgctgctcagtacaagaacactgataaaaaggacaagattttcaatgaatgacagtgccgcgtaggatacggtcatgaacgccaatccaagtacgatcagctttttcattaacgattgcttttgcccgattttgcttcctgttgtataggacgtcacacacataaccaaaagcgggatcgctaaaatcaagccttttttcacgccgtcggtgtcgtatgttttttcaagaacatctgagagataaaacaggatgccgaataaagtaaacaaacaggtcgcaccggctaaataagcggtaaacagccatctgccttcatgtttaaagacacttaacagcccttttgcatattttccgattggtggcggttctttttcctttttcttttctttaataaaaatccaagtcagtacgatcgaaatgatacaaaacacaggaaaggcaaaaaacgcgccataccagacaagcagggcgatcagcgagccaatgatcggcgatagcactttccccatgccgtttgaagcttcaacaaggccgagcaccttgctctcctgggcgcctttaaacagatctcccgtcagtgccatggcaattgggccggttccggctgccccgattccctgtaacgctcgtcctgccatgacccaaggataggcattgtcaaaaaaacctgccgcaaacccggctaacaaaccgccggcaccatacaaaattaagcagggaataatgatgactttccttgagaatcggtctgcgagataaccgacaatcggaatcgcaaatgctgcaatcaaggaaaatactgtgatcacgagactgacttgaaattgtgataaatgaagttcagatttcatttttggcaaaatcggaataagcatcgagtttcctagggttaatattaaagggattgaaccgattgctacaatcgtcattccattattttgttttgatgattccatctcagagcacactccttttcttctgcttagaatgtccctgatggcttcgtttattcagcgatcagacagcaaaaaaccgaacagaagatacctgttcgggaaaaaagagggttaaccgagagcctgtgaaatcaaagcatataagtgtccattttgaataggcgcttttttctgatagaacaaaagcggaggttcatcatctttatgaaatcccatttctatcaggctgtcatgcagagacgtgtgttcactcggtatatcgattcgcatcggcccttgtttgccggccgccagcctgttaattatttgtgctgcaacatctgatgatggagcgatgatggggccgaatttcaaattggccggtgtctgtacagaaagtccgtagccaattagctgtccgtcctgatttcgggcgatgatacattcgcatgaagcagaaataagctgctgcaaaaggtttgatcgatctccgccaaaggcagccagatccgccgcggttaagtcgtgaaagtcttgttctctaaaggatgtcagttcagcatcaagcttttttgtataaggttgaaaactgtgacagctgtactttcgcactgaaccagccgtatgaaaacctgctttttcataaagcggcaaaccttcttttgtggcgcaaagcctgatggcggtgttttcatccgtttgggtgatacaggcgtttaccatacgccggccgagaccgagccgttgatattccttgtcaacgataacgaggccgatagaagcaagactgccaaacaaaaacaagccgatgcaggaaataatatcaccgctgacattttgatagccgaaaaagcgtccttgctggacaagcagtgccagctcttgttcgccgtaatccggccacccggcttgcctgcaaagccgcaataagccggaaacatgttcttcatgaagctcaatcagctcatccactacatccataagatcacctgcttgttcctagtgttttgtacatgacaatatgagtgcctatgccgggaatctcaaacggttcgccgagttcttcccacccaagttttgaatagtagcctttcacatggcttctggcattgcaccagaccgcctgaacgccgttctccgccagtttctcttccgcgtgtttgatcagcgtgctcccgcctttttgatcgcgatatccttcaagcgttgccatgcctctcagccgatatgctggggattctgttattaatggctgaatttgcggggaaaaagaggcgatgctgatcagctttccttcaaaaaacgcgccgagatgaaaggagccttttgcatgatcctcttcatatttgcattgttcaatggattgatggggacgcagaatacggtgccggatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatatatgaagtaagctcagcggttaagtcagatctgaggaaaggcgttatcaagtagatgccgttaaacagctcgcatgccgtatccagcagggagcgtgcaatcgcaaggccttccgccttttgtttttctttatcttcaccggcacgggccattttttcgcgaatcgtatcagacagcttaatgccgggaatttcattatggatgaattcggcattccggctgcttgtcagcggcatgatgccgatatagaccggcgtcttcagatgttttgtttcgttatggatatcgacaagctgctgctcggaatagacaggctgagaaacaaaataatctgcgccgcaatctatttttttctcaagccgttttaccgctttatccagatggcggacgttaggattaaatgcggcggcaactgagaaattcgttttcttgccgagcggttttccagatagagacagaccttcattgaattgtttgatcagcctgattaaatcaaaagatgttaaatcatatacagacgtcgcaccaggaaaatccccgattttagaagggtcacctgtaatcgcaagcacgtcattcagccctaacgtatcaaggcccattaaatgtgactgtaagccgataatgttacggtcacggcaagtaatatggacaagggaacgcatatcgagctgctgcttgacaagggcgccgcaggcaacattgctgatccgcggggtcgccagagaattgtcggcgagtgtcagggcatcgattcccgcttcttttaattcagcagccgccgatagaaatttgtcaaagcttagttttttcggcgggtccagttctacgataatagagcgttttttcgccgcgatctcatccaggccgggctcggttcgctcgtgatgaacagaaatgaattcttttgcccgggttttgacttctttttccgtaatcggagccagcccgccaaccgcttccgccatcgccctgatgtgattcggtgttgtgccgcagcagccgccgataatccgcgcgccttgcttacggaattctgacgcgctgttttgaaaatacgtgtcgtctgtttcatagacgagccgtccctcttcaagcgaaggaagactgctgttcggataaacggataagaatacgtcatcaaaaatcggcacttcgctgagcgcttcaatcatgtgataagggccgaggcggcagttaatgccgacaatatcagctccgagatccgcaatcgagcgcaatgcgtcagaaagcggtgttccgtcctgcaatacgccttgctcgtgcatggagacattgagcataatcggaagatcagtctctttgcgcgcgattttcagcacttcacgggcttcttccaaatcataatacgtttctaacagcaagccatccggctcttcatgcagcagcaggtacagctgctcgcggaagctgcgcttaatttcgtcaagactgtacgcgtttttattaaatgtgcgtatgccgcccatcgttccaagcacgtatgcatcgcctgctgaagcccgtgcgatctttacggcctcctgattcatttttttgatgtcatcctcaagcccgtgtctggataatttaatatagttggccccgtacgtattcgtttgaataatgttggctcccgcttcaacgtacgctttatgtatgcgctgaatttcctccggctttgaaatattgagctcctcaaaacacctgtcaatgccataggagtagaggagcgtccccatggcgccgtcaccgattaacacctgtctttgcaaatcttctaaaagtcccattgtctgcctcctttattcacatcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcagaaagtgccaaaagatacctggcgtttttccctttctccaaatttaccgaaaataaagacaataatcaataggaatcagaaaatttatctgaaatttataaattgaacgtcaactggcaaatctgctccccgcacagctgagataatctgctgcaggtcatctttgttttttccggtgacacgcacttgatcatcctgcacctgagactttactttcagtccggagtttttgatgattgtattgattttttttgcgttgtccttgtcgatgccttgaacaagctttgcacgctggcgtaccgttccgcctgacgcgttttcaaccttgccgtaatcaatgttttttgtcggaacgtttcgtttaatcaatttgctgaccagcacatctttcagctggcttaatttgaattcgtcatcggaaacgaggaccagctcctctttatctaaagaaatgtcgcttttgctgcctttaaagtcatatcgggtactgatttccttcagtgcgatttggattgcgttttgcacttcaggcaattccaccttggatacaatatcaaatgaactttcttttgccatatgaaaacctccataacatttaacttatgtgttgattatagtagaataaagagaaacttccaacagaacaaagaatcaatttgtgatgattggaaaaaatgttaacaaaatccgcagagattaagcggaacaggaaggacgatagcatgagaccagggcagcaattaaccttgagtatagatcaccaaaccgacttcggttactttttaaccgatggggaagatacgattctcttacataacagtgaaatgactgaggatatcgaggacagagacgaagtagaagtctttatatacgtcgaccagcaggaaaggcttgcggccacgatgaaaattccggtcatcagcgcggatgaatatggctgggttgaagtggtggataaagtggaagatatgggcgttttcgttgatgtcggtttatcgaaggacgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgaactgtttaccgacgcttcagaagatctgatgaataaagagctgacaggtacggtgtacaggctaatcgcatcgggttcattcgtgatcacggatgacggtatccgctgttttattcacccgtcagaaagaaaagaggagccaagactgggttcaagagtcacaggccgggtgattcaagtgaaagaagacggttcagtcaacttgtcgctgcttccgagaaaacaggatgcaatgtctgttgatgctgagtgcattctaacgtatatgagaacgagaaacggtgccatgccgtacagtgacaaaagccagcctgacgatatcagagaacgttttaatatgagcaaagccgcctttaaacgcgcactgggccatttgatgaaaaacggaaaagtgtatcaggaaaatggatggacatacgagaaaaaatagcatgaaaacggctcgcctgcagcagactgcggagcgagccgtttttttatgtctagtttaattcatcaaccagcgttctgattgccatttcgcgatccacattgtctgaaatcgcaatcggcgtaatatcaatggcgagaatgatcagaatcagggcacctgctgcagcaacataagaaacataatagaaatagttagcggtatcaacagtgttgacaagctcggcctgaactctggatgtatcatccttggaagcggcgatttcctttgctgcttctactttttcttcaacgatttgacctgcttttttcagcagttcatccactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggaagctgtttgccaacttccccttgggcaaacacaaagcctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatggaaaaactgataaggcctagcatgattgcaaaaatctcatgcataaaaacagcgatgatcaaaatcaatctccaatgcttcttcggcgcaaacaacgccgcgaagatgacaatttgaaccagcagcgtcccccatgtcggaatcaccacgaacggacttgttaccattggcttcgttaacgcctgaaaaaagccgttgaagccaatggttttttcctgggcgaaataatagacggccgttccgtccacccattcctgctgagacagcttagcgacggtagagtgaaaataaagcaccgccacttggattctgatcacagaataagaaataaaagctgttatttttccaagtgttcttttgccctctataggtctcgtgctccaatgccattttctcggatcggtcagcgtgatgggaagcaataaaaaggtcatgacggctgctgcctgctcgcctccgtcgatgacgatcagcgatgactgcaggctgtaactgacataccaatgcagaaccccggtgattctggggcgccagccaatgacaacaagcaccagaatggcaatgcagacccatctgaaaagatttaacatcatatagttattttcgccgaggcaaaagagactgagattcattttacaagctggatagctgctgatcccgctggctggcttcataatgaggctcgggtgattgatgagcagcgtcagcaggctggatagcgcaatgatgcttcgcgcgaggccgtatacatttgtccacgggtttctttcgtcccatctggtgatggtctgttttatgttttcgagcatgagatcacaaccttgactatgctttttacctgataagacgaaggggtgtatttagaatagctccaaggaacaatatcctctttcgtcaaatagtagctgccacaaagcagcgggcggggagcgggtgtttttaattgcacggttttggctttgcttttgcatgcgccgaggtccttttctttacatgctgtccactgttccttgccgacttggctgtagatcacgcccatttcaacgccttgtgaccgcccataccgatacaggccgaataggttgtcagccctcatattgggccatctgaccttggcgctggcattttcagcctcatataagccgattgcagtatcacgcggatttttgctgaaaaagccccagccctgagggaggatgctggacatgagaaatttggagtcctttgtcagcggaatcggggttgtccccaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtgataaaaaggttaaaaagtatgagaaattccatttttgttaaaagaaaaaacaggacattttacactgctatatgtgattgatatatagtgtttttttcgatatatttaaaccatgaaaacgaatcaagttaatgaccgctggattgttcaatttcgaaaagggattttcgagctggccatcctatccctactgcgttctaaaccgatgtacggttatgagctgacgtcatccttaaaaaccacctcggcgctggctatttcagagggagcgatttatccgattctgaaacgtatgaccgagaagggatggatcgaatttttttgggaagattcactggacggcccgaaaagaaagtattacaaaatgacgcaaaaaggagaagaaatgttaaaagaacggctggagaaatacctggaaacccatcaagccttactgtctttatcgggggatttgctatgaatggacagcttatcattgaccgatacatggaggaactaaatgcagagctggcgaatatgcctgatgtagagagagaaaacgctatcgacgaattaaaggggcatatcaccgctttcgttcaagacagaatcaaagccggccttagtgaagaggaactgcaggaagctgttgaatctgaattttctcatccgaaggagcttgccgaattgatgatgggtgatgggggagagacgaaaaggaggaggtctttattgggcaaaagctggatttcggtccttctcattgtcacgattatcgccctgccgctgctgccgtccgacttcagacatctgccgctggctgtttatttaatggtgctcgccggatatgtatggaagcggaaaaaattgatgatgtttgcaggtgtcagaaaaaacaaaatgcgctctcaaaaggagattgtcaagatttcgcgagtcggtgcggtttatctgctgtttttagcagtgctgcttcttttgagcccgttcctcaatgcgcttgtcgtcctgctgctaattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcattttgctgaatagttttatctcatttcaaggtcaggagcagctcatacctccgcttatactggcatatggagcaggggttattatttatgtcaataaaaaattagtagagtaggaaaagaagggcagagcgaaatatctctgcccttcttttttgggaaaataagaacgaagcaccacatacaagtttttgtatttttgataggatgaagaaaaatggtagattccaaaataggaaggatgtggtgttttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcaccgcagaagccgatacaaaacacaacccagaaagaatcgctattttcctatcttgacaagcatcaaacgcagtttaagctcaaagggaatgcgaacagccattttcgcgtttcgaaaaccataaaggatccaaagacaaaacaaacgttttttaaattaacggaggtttacaaaggaattccgatttacggctttgaacaagcggtcgcgataaaggaaaacaaacaagtgaaaagtttctttggaaaggtgcatccgcaaatcaaggacgtctccatcacaccgtctatttctgagaaaaaagcaatacatgcagcaaggcgtgagctcgaggcttccattggaaaaatcgaatatcttgatggggaaccaaaaggcgaattatatatctatccacacgacggtgaatatgatctcgcctaccttgtcagactctcgacatctgaacctgagcctggctattggcattatttcatcgatgccaaaaacggaaaggtcattgagtcctttaatgccattcatgaagcggcaggtacaggaatcggcgtgtcaggtgatgaaaaaagctttgacgtcacagaacaaaatgggcgcttttatttggctgacgaaacaaggggaaaagggatcaatacgtttgacgcgaagaacctgaacgaaaccttgtttacgcttttgtctcaactgatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaatccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactccggatattgcaggagattcattgcggtcattggaggacccatctaagcagggaaatccagatcattactcgaaccgctacacaggaacagaggattatggcggagtccatatcaattcgtccattcacaataaaacagcttatcttcttgcagaaggaggcgtgcaccacgatgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggcattctatgagcaagcaaaaacagtcaggacacagagtctgactgtttttgtttgctcattttcttaaaaagaatatcgccaatgtacctgggccagcatgcgagccgattgctgaactgattggatgcataatgatttctttcggcttgaacgcttcctcaatcaggtgtttcatgtccgtggctttttctttgttcgcggcgtagctgatcccgacggtttgattgctccaatcatccccgcgctctttcataagctcgatgatccgtttgaaaagtttcttctgtccgcgaattttttccagaggcacaagcttgccgtcctccatctgaagcagcggtttaatattcaacaggccgccgacaaaagcggacgttttggatatccggccgcccctcgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcttgaattgtgactgcatcttcgaattctttatcgccgagagaaaccctgagtggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaaaatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgatacctgcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgcactcactactctgtttatggggatcctgccggaaacaagcctgtcacatgacattttgctgaacgcggtgttcggcggcgtcatttcagcagtcggtatcggcttaacattaaaatacggagcttcgacaggcgggcttgatatcgtcgccatggtgcttgcaaagtggaaggataaacccgtcggcacgtatttcttcattctgaacgggattatcatcttgacggcaggattattgcaaggttgggagaaagcattatataccctggttacgctgtatgtgacaacaagggtgatcgacgccattcacactcgccacatgaagctcacggcaatgatcgtgacgaaaaaggcggacgaaatcaaggaagccatttacggaaaaatggtgcgcggcatcacaactgttccggcaaaaggagcttttacgaacgaacagaaagaaatgatgattatcgtcatcacgaggtatgaactgtacgatttagaaaagatcgtcaaagaagttgatccgaaagcatttacgaacattgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagcgaacgtgctattgagtttcaattcagcacagggcaaaaatttgaacttgtcgtgtatgattctgagcacaaagaaagataccgttattcgaaagacaaaatgtttacgcaggcttttcaaaacctgacgcttgaatctggagaaacatatgatttctctgatgtgtggaaggaagtcccggagcccggaacctatgaggtaaaggtgacatttaagggcagggcggaaaatctcaagcaggttcaggctgttcagcagtttgaagtcaaataagaggctatggcgagtcgccatagcctttttttattggagtttgtccagctgattttgaaattgatgcagctgttgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcaacctggctttcggccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggcaaagtaaggtttatgagtgggaaaaattaatacggaccttctttaaagtgagaaatattctttcaaaaaccttgcaacgccgtcctcttcatttgtagccgttgttcggttggcaatctgcttgaccgcgtcaattccatttcccattgcaacgccgcagcctgcaaattcaagcatttccaaatcgttatcctcatccccgaaagcaatgatccgctccctcggcacgccgtaataatcgctgattttctgaaggccgaccgctttattcatgccgcttttgataatttcaatgacatgccacggtgcagcccatcttctatggtcgattacctcggcatgcacatctgataaatatgagcgtattgccggcacatcctcttcttttgcatgtatgagtacagacgtcacatcttcaccaagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccatctgtcgtcttgcggatgatggacaaatgctccgttaaaattgacaattggcgttgtcaactccatctgctggtagtacatggaacttgaacgatacggacggcctgttgagatgcagacataatgcccgtcatcttttaggcgctgtatcgtatgaagggtgttttcagatatggttttatcatcctttaataatgttccatctaaatctaatgcgattaaatagggttttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatacatggttttacaagcgcgaaggaacacaaccttcatattgcttatctgcttgcggagaagggttttagagccgttctgccggaggctttgcaccatggggaacggggagaagaaatggctgtcgaagagctggcggggcatttttgggatatcgtccttaacgagattgaagagatcggcgtacttaaaaaccattttgaaaaagagggcctgatagacggcggccgcatcggtctcgcaggcacgtcaatgggcggcatcacaacgcttggcgctttgactgcatatgattggataaaagccggcgtcagcctgatgggaagccccaattacgtggagctgtttcagcagcagattgaccatattcaatctcagggcattgaaatcgatgtgccggaagagaaggtacaggtgctgatgaaacgtctcgaattgcgggatctcagccttcagccggagaaactgcaacagcgcccgcttttattttggcacggcgcaaaagataaggtcgtgccttacgcgccgacccggaaattttatgacacgatcaaatcccattacagcgagcagccggaacgcctgcaatttatcggagatgaaaacgctgaccataaagtcccgcgggcagctgtgttaaaaacgattgaatggtttgaaacgtacttataaagcacgaagttattaacaagggctgaatttacgttatactgtagaaaaaaggagtgagggaacgtggaagaagcattaaaagaaaacatcatgggcgccctagaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaagaggacagcctgacatgtgaggctgtccttttttacagctgaaaggagtgaaaggaaatgatgtacctgctggcagttttatgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggcaagaagataatttggaaaaatgaggacgcagtcatggtataatggtcataaaaacagcagggagagcactatgaaaaagaaattgcttgcattcgcgctttgtactggcgcgtatgcggccctgtttgcgtactctgtgaactcagagcaaaaaacagccacaagcgagatgacggatgtcagccgcctgatgcctgtaaaaataaagcagacagtgaaagggcaggaagaggaaacgctcattgacacagtcaaagaggcaaatcgaaaaaacataaaaatttcaatcgccggggcccagcactccatgggcggccatacatattatgaggacggcatcgttctcgacatgacgggctacaacaaaatcctgtcactcgatcaagagaagaaaaccatcagggtgcaaagcggtgcaacgtggaatgatatccagaaatacgtgaatccatacggactcgcggtaaaagtcatgcagtcacaaaacatttttacaatcggcggatctctcagcgcaaatgcacacgggcgtgatattcgctacggctcgctgattgatacagtcaaatcattccggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatacgcagactatttttcaaagcatgtaaaaggaaatccagatgtccgaatgcacctggcgcgaatttcaacagcgaaaaaaggatttctgaaagacatgtatgtcacaaattacgtattggctgatcatcaggatcaactgccatcatacagcgatctcaaagaagatgagtatacgggagccacaaagtttgcactcggtttgtcaagacggtatgaatggggcaggaattggctgtgggacacacagcaatcctatttcctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacttgctgaacattacgatccgctacgtgcagaaaaatgaaaaggccgacctttcctatgcgaaggacgatatgttttcgctcgtgctattaataaacgagggcttttcaaaagaagaccaggcagatactgcccgaatcatcaggcgcatgacagacgttgccatcaagcacggcggcagctattatctgccttatatgacctaccagacaaaagagcaaatgagacaggcatatccgaaaagtgaagcgttttttcagaaaaaacgaacctatgacccggatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgttcgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtacatcgtccaagtgctgttagggctctttggagcgatgcaaaagcatggagaaaaagtgctgatcgctaattttacagacagcggagagcgtggaaagaagattggaaattaccatttttggacagctgtcttttcagcagcagccattatgctcggggctttctcgctgacttttttacagtgcaaatgattttttatgcaagctctattctatattttttgagtggattgatgatgatgaaaacaggctgacgcggtcagcctgtttttttatgcggctgaaatgcggcgccgcatcaacgtttttgtgctgaagtcatgctgatttttttgagcggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcaccgaacttgtcaggattctttcgcaacatcctcatgcagaggaatgcatactttattcatccagcggagaagggaatgtctatagcgagggttatcctcatcttaccggcttagcggatcagcagctgaagccgattgatatgaatacgatcaaacacgaaatagatatcatgtttctcgctgcgccgcccggagtatcaagtgaattgactccaaagctggcagacgcgggaattccggttattgatctgtcaggtgatctgaggatacaagaaccggctgaatatgaaaaatggtataaacggacagcggcaccgaaggcggtgattcaagaggcggtatacggtctggcagaactgaatcaacagcaaattcaacaggcgaaactcattgccaatccaggctgttttccaacagctgttttgcttggcctcgcgccattggctcaaaagaaactgctcgatgaatctttcgttatcgttgacgcgaagacgggtgtttccggagcgggaagaaaagcatccatgggaacccatttttctgagctgaacgacaattttaaaatttacaaagtcaatgaacatcagcacacgccggaaattgagcaggcgctgaatgaatggcagccaggtctcgggcccattacattttcggctcacttggttccgatgacaaggggcatcatggcgacgatgtataccagattaacctgtgatctatccgcagatggcctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcaccatcacgccaatttatccatagaacgggagagaatcgaaccatgattcagttaagtgaagatcaaattgtaaaagtaacaggtgatgtatcctcgccaaaagggtttcaggcaaagggtgtgcattgcgggctgcgctactcgaaaaaagacctcggcgtcattatcagcgagacaccggctgtgagtgcagcagtttatacccaaagccactttcaggctgctccgatcaaagtgacacaagacagcttaaagcacggaccgacactgaaagccgtcatcgtcaacagcgccattgccaacgcctgcacgggagaacagggcctaaaggacgcatacacaatgcgggagagctttgcttcacagcttggcattgagccggagcttgtcgctgtttcatcaacgggtgtcatcggcgagcatttagacatggaaaaaatccacgcggggatcgagctgctgaaagaaacacctgcgggatcaggcgattttgaggaagcgatcttaacaacagatacggtgattaagcagacgtgctatgagctggcaatcggcggcaaaacagtcacgatcggcggagcggccaaaggctcagggatgatacatccgaacatggccacgatgctgggatttgtgacaactgacgcggcaattgaagaaaaagcgctgcaaaaggcgcttcgggaaatcactgacgtttcatttaaccaaatcacagttgacggagaaacatccacgaacgatatggtattagttatggcgaatggctgcgccgaaaacgagtgcctgacagaagaccatccagactggccggtctttaaaaaagcgctcttgctcacttgtgaggatctggctaaagagattgccagagacggagaaggcgcgacaaaactaattgaagcccaagtgcagggagcgaaaaacaatcttgatgcaaacgtcattgccaaaaagattgtcggctcaaatcttgtaaaaacggcagtatacggaacagatgccaactgggggcggatcatcggagccattggacactccgcagcacaggtgacggcagaagaagtagaggtttatcttggcggccaatgcctgtttaagaataacgaacctcagccattctctgaatctatcgccaaggaataccttgaagaagatgaaatcaccattgtcatcaagatggatgaaggggacggaaacgggagagcgtggggctgtgacctgacctatgactatatcaaaattaacgcgagctatcgcacgtaataaaggggagcgaaatgaagaaaacaatcgtttttaaatgcgggggaagtgtcatccgtgagctgtcggaggaattttttcaaaatctgaaagagctgatggcatcaggctggaagctggcgatcgtacatggcgggggaccggaaatcacaaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgcaaaacgctgaatgtaaatgctgatctggctgcttcagcagtcgccggagcgcttgaagccgataagctgatgttcgtcacggatgtcgatggaatcatgaaggaaaagcaacgtctggacgtcctgacccctaaggagattcagatgctgatcaagcaggaagtgatcaccggagggatgatcccgaaggtcaattcagccttgtcagctttatcagatcaggtgtctgaagtcatgatcgtaaacggaaaaggttcattcttcgcagaacaaacctttcaagggacaaaaatcgtcaaagcaaaggaggctgtttcatgagcagcttgtttcaaacctacggccgttgggatattgacatcaaaaaagcaaagggaacgtacgttgaggatcaaaacggcaaatcataccttgatttcattcaggggattgcggtatcaaatctaggacactgccatgaagcggtgacagaagcagtcaaaaaacagcttgacagcgtatggcacgtatccaacctgtttcaaaacagtctccaagagcaagcagcgcagaagctggcagcgcatagtgcaggagatcttgtctttttctgcaacagcggcgcagaggcgaatgaaggtgcgataaagcttgcccgaaaagcaactggaaaaacaaaaatcatcacttttcttcagtcgttccatggccgcacgtatgcagggatggctgcgaccggacaggataaaatcaaaacaggcttcggcccgatgcttgaaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagcccttctcatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttttgcaagaggctgctgacaaaggagcgtttttaaaaggacagcttgaggcagagctaaagagcccttttgttaaacaaatccgaggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagccgtcagcaagctgaaacaggcaatcgctcatcattccgctgtaaaccagtgattttttttcgatataaaggcataaaaattcatttttataattaattattcatcaagaggtgggctgttagatggaaggttatttagtgttagaagatgggacatcgttcagcggcgagctggacggccatgaaaactgtacgggagaagctgtttttttcacaggaatgacaggctaccaagaagtgctgacagatccatcatataagggacagattattgtatttacctacccgctgattggcaactacggcataaatgaaaaggattttgaaagcaagaaaccgcaagtaaaagccgcagttgtctatgaggcgtgtgatcacttttctcattatgaagcggtatacagcctcaaggagtatttacagaaatggaacattccgctgttaacccatgttgatacgagggctgtcgtgaagaaaatccgggcaaacgggacgatgggtgcgtcagttacagcctctaaagaaggagctgagattgcccttcaaccagagaatgtggcagagcaggcttcagcccaggaaatcagcacatttggtgacgggaataaacatatcgctctcattgattttggctataaaaagtcaatcgcatcatcacttgtcaaaagaggctgcaaggttaccgtggtgccataccagcaaatggaggccgtatacaacatcaaacccgatggcattgtgctatcgaacggacctggagatccgaaagcaatccatccatatttaggaaagatcaaaagcatcatcagccgctttccgactctaggcatttgtctcggacatcagctgatcgcgctcgcgtttggagggaatacttttaagctgccattcgggcacaggggagctaatcatacggtcatcgaccgtgagacgaaacgggtctttatgacaagccaaaaccacagctatgtggttgatgaacagtcgattaatgaagaagagctcaccatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctatcgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagacagcgttgaatttagcggtggagcttgaagaaacgggtgttttaaaagagcacggcgtcaagctcctcggcacatccgttgaaacgatacaaaaaggagaggaccgggaaaaattccgttcgttaatgaatgaattaaaacagcccgtgccggagagtgaaattgttgataacgaggccgatgccctccattttgcggaatccatcggttttcctgttattatcagaccggcttacacattaggcggaaagggcggaggaatcgcccctgataaagaagcctttacagctatgattaagcaggcgctattagcaagcccgatcaatcaatgccttgtcgaaaaaagcattgccggctttaaagaaattgaatatgaagtcatgcgtgacagcaataacacatgcattaccgtctgcaatatggaaaatatcgatccggtcggcgtgcatacaggtgactctattgttgtggcgccgtcacaaacattgacagacgaagactatcaaatgctgcggacagcaagtctgacgatcatctcagcactcgatgttgtaggcggctgcaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacacccttgacgagctgaaaaatccgctcacaggctcgacttacgcaagctttgaaccggcactggactatgtgatcgtcaaatttccgcgctggccgtttgataaattcaaaaacgcagaccgcaagcttggcacaaaaatgaaagccaccggtgaagtgatggcgattgaacggaatttagaagcggcgatacaaaaggcagccgtgtcgcttgaattaaaaaatatcgggacacaccttccagagctcagcgggttgtcaattgatacgctatgggatttggcaatcactccggatgaccgcagatttttcgttgtcatggagctgttgagccgcagcgtctcgattgatgacatccatgaaaaaacaaaaattgatccgtttttccttcatacctttgacaacatcatcaaattggaaaaccgcctgatggaagcagggagcgatctctcttttgaattattgaagaaagcaaaggaaaagggattctcagacgcaacgattgcctcgctgatcggcaaaacagaagaagaggtgcgcgcgcttcgcaaggagatgggcattacgccttcctttaaaatcgtagatacatgcgcagcagagtttgatgcgaaaacaaactatttttactccacatatttcggagagaccgatggagacatcagccgcaaagagaaaaaacgcgcgctcattatcggatcaggcccgattcggatcggccaaggcgttgaatttgattatagtgctgttcacggtgtgctgacactgcaagagcttgggttcgaaaccatcatgattaacaataacccggaaacggtcagcacagattatgaaattgcggatcgcctgtattttgaaccgatgacaacggagcatattgtaaacgttgcggagcaggaaaatattgattttgcaattgtgcaattcggcggccaaactgcaatcaatgctgctgaagcgctcgaaaaagccggcattactcttcttggcacatcatttcaaacgctcgacgtgctagaggatcgggatcaattctatcagcttcttgacgagctgggattgaagcacgcaaaaggagaaattgcttatacaaaagaagaagccgcttcaaaagcgagtgagatcggctatccggtgttaatccgcccatcttacgttatcggcggaatgggcatgatcattgttgactcgcaagaccagcttactcagctgctgaatgatgaggacagcatgccatacccgattttgattgatcagtatgtgtctggaaaggaagtcgaaattgatttgatttccgacggcgaggatgtctttatcccgacatataccgagcatattgaacgggcaggtgtccattcaggggacagctttgccattcttcccggaccgtccatcacgagcgggctgcagcagggcatgaaagatgcggcacaaaaaattgcccgaaaactttcatttaaaggcatcatgaacattcaatttgtgatcgacaatggaaacatactcgttcttgaagtgaatccgagagcgagccgcacggttcctgtcgtcagcaaagtaatgggcgttccgatgattccgctcgccacacgtctgctagcgggagcgtccttaaaagatctaaatccggcagttcaaaatcatcatggagttgccgtgaagttccctgttttttcttctcatgcgatccaggatgtggatgtcaagcttgggccggaaatgaaatcaacgggagaaggcatgtgtgtcgcatatgattctaacagcgccttgaaaaaaatctatacaagagtctggagtcaaaaaggaagcatttatttgcaaaacgttccggaagatgtgagggagttagcagaaaacgcaggttttacaattcatgaaggggcatttgcctcttggatggaacaggaagggaaatcgctccacatcaatctgagcggttctgaagaagcacgcaaagaacgtttggaagccatgacgcacggcatccccgtctttacagaagaagaaaccgtgcgggcgtttttacaaagcggttcaggccatccgcagcctgtatctctcaaagacctctataaaaaggaagtggcaacatgcacacagtgacgcaaaccagtttatacggaaaagatttattaacgttaaaggaccttagtgaagaggatataaacgccttgctcgcagaagccggtgagctgaaacaaaacaaaattcagcctatattccatggcaaaaccttggcgatgatttttgaaaaatcatcaacgcggacacgtgtttcatttgaagcgggcatggcgcagcttggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttactgataaataccacccatgccaggcgctggcggatctcttgacgattaaggagataaaagggaagcttaatggcgtaaaagtcgcatacatcggtgacggaaataacgtggcgcactccttgatgatcggctgcgcgaaaatgggctgtgatatctcaatcgcttcgccaaagggatatgaagtgttagatgaagcagctgaagcggcaaaaacatatgcacttcaatccggctcttctatcacgctgacagatgatccgattgaagctgtaaaagacgcagacgtgatttattctgatgtgtttacaagcatggggcaggaagcggaagagcaagaacgtcttgctgtctttgcgccttatcaggtgaatgcggcgcttgtcagccatgccaagcctgactatacatttttacattgtctccctgcgcatcgtgaggaagaagtgactgcggagattattgacgggccgaactctgcagtgttccagcaggcggaaaaccgtcttcatgtgcaaaaagcactgctgaaggccattttatacaaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaatcggcgagacagggagcatggttaaaaaccctcaaaaggtccatctgtcagcaggggaaatgttccccgaaacatcaaaccacaaccggctgtggacttacaaaagaaagccgtgaccactaaaaaacccaaaacaataaatgttttgggttttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaaggggaaatccaattttagcagaaagtgaggtgacaaaagagtctgattcgtcacactttaatggtaaaatataaaaaacgtcaatcagtataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggcatctttatcttgggggacagaacccactttgtcggacatgattcaagcttttggcagcagcattacggcagaaatcagcttctgagcatgttgatgaatgaaggatatactctttttaacagcaatctgttcggaaggcattgggggcggaaaaagcagtcacctatgccaaacagctgatacattctgtgctgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataagcaatttttgaaagaagtatcgaaaagctacggaatttctgaaaaagaagcggaagcgcttcgttataaaacaattcaaagctacccgagcggcgtaccggttcatatatggcagcgtatgaccggatctccatatccctacagtgtacatgcagaagttttcaaggaaaaacagcaaaagcaaggctcaccggtcgacatgacatttcatttatttgagcatccaagcagaatttatgcatcaatttgcaaattctttcacagtcatgaaaaagaattatagagaatataatgacaacagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgaacacattggagaccaaaattatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaagacggctattacacaaacgacgtcgctgacgagttgctgagattcctgttagaaccaagccgtcatagcaaagatcagctttttgaattgcaagtcacagagaaaatctcaaaagaagaagcaaaaacaaaaattatcgagtggaaaagacaattttcatcaattttcgacaaatattaagaaaaaccttccatgtttcgagttttctagatacaataaacgtataaaaataaacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgatacgattaatgacctcgtatggggcacaaaagggtataaaggattactgaatatacaatccaaatacaatgtggacgtctattataaagaaggcgttaaaacagaagaagatatcataaatgcgattgaggattttcataagaggggcgtcaatctgctctacggccatgggagtgaatatgctgaggtgtttaacttggtcggcgaagattatccagatatggaattcgtcatttccaatgcgaaagcgaaagctgataatgtaacgagtgtccattttagcggggaagcaatgggcttttttggaggaatgactgctgcccatatgtcgaaaacgaatcaggtcggtgtaattgcctcctttacgtggcagcctgaggttgatggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaataaaggcacccttgagggcggcgatcattactacgacctgaatacgggagtcgttgagatgggaacattcagcccgctcgtcgacaaagactttcagcaaagaatcgccaagctgatcaaaacatacaacaaaacaggcgagctgccaaaaaacgaataatggagtgacgtcacatgcagcacgaaaaatcacttgaattcttgcaaattgccatgaaatatctccctgaagcgaaagaacagcttgagaaatcaggcattgagctctcaatggaggccatccagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaatgaatcgtctcttcgtcgtttgtctgagaaacctgagaaacctcctcttgctgttcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttcccttatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgattgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgtcaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattagaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagacgcagatcttaacattaccgatgagatcgcaccgagagtcggtgtttgggtaggctccggtatcggaggacttgaaacactagagtctcaatttgaaatcttcttaacaaaaggtccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggtgatgcagacgtgatggtcacaggcggaacagaagcgccgctgacaagaatgtcattcgccggctttagtgccaacaaagcgctgtctactaatccagatccgaaaacagcgagccgcccgttcgataaaaaccgtgatggttttgtcatgggggaaggtgcagggattatcgttcttgaagaacttgaacatgccctggcccgcggcgctaaaatttacggagaaattgtcggctacggttcaaccggagacgcttatcatatcacagcgccggcccaagacggtgaaggcggagcgagagcgatgcaagaagccattaaagatgcaggcattgcacctgaagaaattgattacatcaatgctcacgggacaagcacatattacaacgacaaatacgaaacaatggcgattaagactgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacgcctgacgaagaatgcgatttggattatgtgcctgatgaagcccgcagacaggaacttaattatgttctcagcaactcattaggattcggcggacacaacgcaacattaatctttaagaaatatcaatcataatcaagccaaaccggctgcccttaaagggtagccggttttttttgtgtgcataggattaaaagaggaggcgatcacatgagtgtagaacaaacatatagctggctcaggaaggctgattcaatagatgatttggcgcattatattatcccgcttttttcaggtgcggagaaaaagaactggaagggcattctagggcatcttcagcatcatgggatgtttaaaaacataaaagagggtattcagactgtttccaagctgaaggaaaaaggtttttacggacatatccaaaaggaagaacagtacctcaaaaacaaatggcaaggtcctgatgtaccaattgtcacgctgccggttgatgaacgaaacaggagaatccgtttagaattcggatcaaaatcaggactcgcctttcaagacaaaatgttcctttttctttcgtcagatttagattttgggtcagtatctgcccttatgacgcatgagtatcatcacgtttgccggttaggtcatctgacaaaagaggaaaaggatgtcacattacttgatacaatcatcatggaagggctggcggaatatgctgtttatgagaggttcggccgaagtcaaacggctgagtggacgacttggtatacaccggagcagcttcaggctttatatgaaaaaaagattgcgccccatcaggatatcaaacgggataatcgattatttccccagctgttattcggcaaaggatatcagccaaaaatgcttggatacgcagttggattcaatattgtaaaaaaatatttaactgccagcaaggcaagcaccgcagacgggctgtccattcctgctgaaacctttttggatgcaatgctttaaaaggataaaataatggaatttcattaataatattacatttatcctaaaaaattcttgattttgcaaaatgattgtaataatatacaactataaaatttttcgataattcaatattatttattatttctgaataaagggattgctttctcttgaaaacgtttgacaacaagagggggaaaggggagctagcatgagcacacttttagaagtgaataatttaaagacttattttttcaggaaaaaggagccgatccctgcggttgacggagtcgattttcacatcagcaaaggcgaaaccgtcgcgcttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgagctgttgaactcttgcagatggtcggtttctcccgggcggagcaaattatgaaggagtacccgcatcggctgtccggcggtatgagacagagggtgatgattgccatcgcactgagctgtaatcctaaactgctgattgccgatgaaccaacgacagcgctggatgtgacaatacaagcccaggtgctggaactcatgaaagatctctgtcagaagttcaatacatcgattcttctcatcacacacgacttaggtgtcgtgtctgaagctgccgatagagtaattgtcatgtactgcggacaagtcgtagaaaatgctaccgttgatgacttatttttagaaccgcttcatccgtatacagaaggcctgcttacgtcaattcctgttatagatggagagattgataaattaaatgcgattaaaggcagtgtgcctacaccggataatctgccgccggggtgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttttaaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccagccgttatccccatgagttttcaggcggccagcgtcagcggatcggcattgccagagcactcactttgaatccagagctgatcattgcagatgagccggtttccgcacttgatgtatccattcaggcccaagtgattaacttgatggaggaattacaggaagaatttaatcttacgtatctatttatctctcatgatctgagtgtcgtacgccatatcagcgacagagtcggagtaatgtatcttggcaaaatgatggagctgaccggcaagcatgagctttatgacaacccgcttcacccatatacccaagcgcttttatcctccgttccagttacaagaaaaagaggatctgtcaaacgtgaacgcattgtcctgaagggagaactgcctagtccggccaacccgccaaaaggctgcgtattccacacaagatgtcctgttgcaaaaccgatatgcaaggaacaaataccagaatttaaagaagctgctcccagccactttgtggcttgtcacctttatagctaatgttgcccgcacagctttgagagggggtatgcacactacataaacaacagctgagaagaacgaacatttcaagaggggaaatatctaatgaaaagacggaaaaccgcactgatgatgctaagtgtattgatggttctggccatctttttatcagcctgctcgggatcaaaatcaagcaacagcagcgagaaaaaatcagcaggcaaaccgcagcaaggcggggatttggttgttggttcaatcggagaacccacactttttaactctctgtattctacggatgacgcaagtacggatattgaaaatatgctgtacagctttttaacgaaaacggatgaaaaactaaatgtgaaattgtcactcgctgaaagcattaaagaattagacggcggccttgcatatgatgtgaaaattaaaaaaggcgttaagtttcatgacggaaaagaactgactgcagacgacgtcgtatttacgtacagtgtccctttaagcaaagattacaagggagaacgcggttcaacatatgaaatgctgaaatccgtagaaaaaaaaggcgattacgaagtcttgtttaagctgaaatataaagacggtaatttctacaacaatgcgttagacagcacagctattctgccgaaacatattctcggtaatgttccgattgccgatttagaagaaaatgagtttaacagaaagaaaccaatcggttcaggaccatttaagtttaaggaatggaagcagggccaatatattaagctcgaagcgaatgatgattactttgaaggaagaccgtatttagatactgtgacgtataaagtcattcctgacgcaaatgctgccgttgctcagctgcaggcaggcgatattaatttctttaatgtgcccgccactgactacaaaacggctgaaaaattcaacaacctaaaaatcgttactgatttggcattaagttatgtgtacatcgggtggaatgaaaaaaatgaattattcaaggataaagaggttcgtcaagcgctgacaaccgctcttgaccgcgagtcaatcgtcagccaagtattagatggagacggcgaggtagcttacattccggaaagccctttatcttggaactatcctaaagatatagatgttccgaaatttgagtacaacgagaaaaaagcgaaacagatgcttgcagaagccggctggaaagatacgaacggtgacggcattctggataaagacggaaagaaattctcgtttacccttaaaacgaaccaaggaaacaaagtccgtgaagacatcgctgtcgtcgttcaggaacagctgaaaaaaatcggcattgaagtgaaaacccagatcgttgaatggagcgctctcgttgaacaaatgaatcctccgaattgggattttgatgcaatggtcatgggatggagtttatccacattcccggatcaatatgatattttccattcaagccagattaaaaagggtttgaactacgtttggtataaaaatgccgaagcggataaactcatgaaagatgcaaaatcaatcagtgacagaaagcagtattcaaaagaatatgagcaaatctatcaaaaaattgcggaagatcagccatatacgttcttgtattatcctaacaaccatatggcaatgccggaaaatcttgaaggatacaaatatcatccgaaacgtgatttgtataatattgaaaaatggtggcttgcaaaataaatttcccttaaaggggagggagagcgttttctccctcttctgtttttaataaggaaagtaaagggggacaagtatatggctgcatatattatcagaagaaccttaatgtctatcccgattttattgggaattacgattttatcatttgttatcatgaaagccgcgcccggagatccgatgacattaatgatggacccgaaaatcagccaggctgacagagagcagtttattgaaaaatacggtctgaatgatcctcagtacgttcaatatttaaagtggctaggcaacatggtgcagggtgatttcggaacgtctattgtcagaaaaggaacgcctgtttcagaattgattatggcaagactacccaatacgctcctgctgatgctggtttcaacgattttggctcttatgatttctattccgttcggtgtcctgtcggcaaagcggccgtattcaaaaatcgactatggcattacatttacctcgtttataggcctggctattccaaacttttggtttggattaattttgattatggtgttatctgtaaatctcggctggtttccaaccgggggtgtcgagacgctgaataccgaattcaatatatttgaccggattcatcatttaattctgcctgcattcgttctagctacagctgacatggccggactgacgagatacacgagatccaatatgcttgatgtattaaatcaagattatattcgcacagcaagagcaaaaggatttaaagagaacagagtgctatttaaacatggattgaggaatgcattattacccgtcattacaattttcggtttgatgattccttcatttatcggcggatctgtcgttgtcgaacaaattttcacttggccgggattaggaaagctgtttgtcgattcagcattccagcgcgattatccggttatcatggcaatgactgtgatctcggcggttcttgtcgttgtcggaaacctcattgcagacatcctttactcgattgttgatccgcggatcgaatattaaaaggagggaaacagagatgtcagagctgcaaacaactccctcgccggagatcaggctgaaagaaaatatttcgaaaaagccagaaacaatgacaaagattttctgggaaaaattctcgaaaaacaaactggccattttaggtgccgttattctttttatcattattatgtctgctgttttcgcccctttaattgcaccttatccccaagagcagcaaagcctgcttgataaatataaggcgccgggccttgaacatctgatgggaacggataaatttggacgtgatattttcagccggatcctatatggagcgcgtgtctctttattggttggatttgcgtccgtagtcggttcgattttgatcggaactgttttaggagcattagccggatatttcagaggaatagtggatgctgtcattatgcgtgtagttgacattgtgttatccattcctgatattttcttgttgatcacgctggtcaccatcttcaagccgggtgtggacaaactgattttaattttctgtctcacaggatggaccacaacagcacgattagtaaggggagaattcttgtcgctccgttcaagggaatatgttcttgctgctaaaacaattggaacaaaaacgcacaaaattattttttctcatatcctgcccaatgcgttaggaccgattattgtgtcagctacgctgaaagtagggtctgttattctagctgaatcggcgctaagctacttgggctttggaatccagccgccaatcgctagctgggggaacatgcttcaagacgcacagaatttcacagtaatggttcaagcatggtggtacccgttatttcccgggctatttattttaatgaccgttttatgcttcaactttgtcggtgatggcctgcgggatgcgcttgacccgaaaaatattaaataaaaatgaatatcatatctgtgataaaatatcaccaaatcagaaaaaaagcaggtctccttttgttagaaaatatacaaagagatctgctttttgcgattcttacataaaactagtgattccagatttcctcaatctctttggaataatttctctatcccttgcctatactgtggacaacagtttttataaaagtgaggggttagagatgttatttcttcatgatgtgtgggtcaattggtttgaaggggaagaaaatggctacaatgtatgccactttcacgaatggcgcaaggaagatacggttgagcttttggatcaggtgccgctgttaagggtgccgtcagtactgtttcattacatagaaaacgatttgtcagagcttccgaaaggtttgcttgaagacgtacatcagaaatcgtacattcggaaaaatcatgagcggacaaagcttgagtattgttttgtcgtaacagacggaatcggcattttagctgtcgacacgatcggctacacgatccctgtcagaaaaagccgtctgatcccaagacaggagcagctcgtttatgaaatggtaaaagatgtagagcctgaaacatatgaatttgagccaaagaagctggaatcctccaaggaatatcacatcttatcattagcaccagaacatgtcagaggactgacaagaaaagaacggcaaattaagcagctgatgtttatggcgcttgaccaattaaaagggctgaaaaaccgggcggaaattggctactggtacacagagtggaatccgcatatgtatgaacaaatcaaaaggatgagctttgaagagatttgggacatgctgtataacgaaacaattgaaggctggtcggacaaacacctagctttttgcgaaaacctaataaaaggacagccttttttcgaaaagttatgggaaatggaaaacgaatcaaaggtcaactgaaaaaaaccgctctttgcaaagagcggttttttgattagcgtctttttcttccaagacccatggcattctccatttttttcagcattttgtttgctgtccgattcgctcgttccgcgccttcatcaagaatccggtctaattcttcagattctaccagctcgtaatagcggtcctggatcggttttaatgcgttcaccacgacttctgccaaatcacctttaaactcgccgtagccttttccttcgtattttgcttcaagctcttcaattgtcgtattgccgaggattgaataaattgtaagaaggttggaaacgcccggtttgttttccttatcaaatttcacaatgccttcagaatctgtcacagcgcttttgattttcttttcaagaagcttcggttcatccagcagggtaatataagctttctgattcggatcagatttgctcattttcttcagcggatcattcagagacatgatacgtgcaccgacttttggaattttcacttccggaatcgtaaagatgtcgttgtattttttgttgaagcgttctgcaagattccgcgtcagctcaaggtgctgcttttgatcctcgccgacaggtacaagatccgttccgtacagcagaatatcagcggccatcagcggcggatacgttaacaggccggagacgacagcttcattgcctttggatttgtccttaaattgagtcatccgctcaagctcgccgatatatgcgacacactgcatcatccatccggcctgcgcatgcgcgggacctctgactgaataaacaatgttgctttttctggatcaagtccgacagctaagtaaagcgccgcgagattgcggatattctttctaagctcaagccggtcttgaggaacggttatcgcatgctgatcgacgatgcaaaaatagctgttataatcatgctgcagctcgacaaactgcttcattgcaccgatatagttgccgagcgtcactgagccgcttggctgaatgcctgaaaaaatcgtttgtttcatgaaaacatcaacctcatttcttaaaacataataaaaaaggctcattcttcccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctctcagcaccgcagactctcttcaaacaggtgaaatgtgtactactctttttcatagcaagcttttcttttgattgcttcattataaatcaattataaccaattgtcatcatgaaaaaacattcttttttccagtaaaattgtaataatataaataacacgggtgctgtaaaatccttaaatgataactgctatcatcgtaaaaacaggcagatattatatgtaaaaagcaatatgggcagaaaacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagttgtggaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttagcggcagcggatcaaacggtgaggggaaaaaggacagtaaaggaaagacgacacttaacattaatattaaaactgagccgttttccttacatccgggattggcaaatgattcagtatcaggcggtgtcatccgtcagacttttgaaggattgacacgtatcaatgcagatggtgagcctgaagaaggcatggcttctaaaattgaaacgagcaaggacggaaagacatatacatttaccattcgtgatggtgtgaaatggtctaatggagaccctgtaacagcacaagattttgaatatgcttggaaatgggcgcttgatcctaataacgaatcgcaatacgcttaccagctctactacataaaaggtgctgaagcggcgaataccggcaaaggcagcctagatgatgtggcagtaaaagctgtgaatgacaaaacgctgaaggttgaattaaataacccgacgccatatttcactgaattaactgcgttctatacgtatatgccgatcaacaagaaaattgcagagaaaaataaaaagtggaatacaaatgccggagatgattatgtatcaaacgggccgttcaaaatgacggcatggaaacacagcggctctattactctcgaaaaaaatgaccagtattgggataaagacaaagtcaaactgaagaaaattgatatggttatgatcaacaataacaatacggaactgaaaaaattccaagctggcgaacttgattgggccggtatgccgctcggacagcttccgacagaatccctgccgaccctgaaaaaagacggttctttacatgttgagccgattgcaggtgtgtattggtacaaattcaacactgaagctaagccattagacaacgtaaatatccgtaaagctttaacatattcgcttgaccgtcagtcgattgttaaaaacgttacgcaaggagaacaaatcccggcaatggctgcagtgccgcctacaatgaagggatttgaggataacaaagaaggatacttcaaagacaatgatgtcaaaacagcaaaagaataccttgataaaggcctaaaagaaatgggcttaagcaaggcatctgatttgccaaaaatcaaattgtcttacaacactgatgacgcacacgcgaaaatcgctcaagcagtacaagaaatgtggaagaaaaatttaggcgttgatgttgagcttgataactcagagtggaatgtctatattgataagctccacagccaagattatcaaatcggccgtatgggctggctcggcgacttcaatgatcctatcaacttccttgaattgttccgcgacaaaaacggaggaaataacgatacaggctgggaaaatccagaattcaaaaagcttctgaatcagtcacaaactgaaacagataaaacaaaacgtgcagagctgctgaaaaaagcagaaggtattttcattgatgaaatgccggttgccccaatctatttctatactgatacttgggtacaggatgaaaacctaaaaggtgttatcatgccaggtactggtgaggtttatttcagaaacgcatattttaaataaagctacgtctgaaaataaaagacctcaaggtatatggggagaaaagccccatatacctttcttactgatggagtataaaaatgtaaaaaccatggaggtgttcccccttgctaaaatatatcggaagacgtttagtctatatgattatcacactatttgtgattgtaactgtgacattcttcttaatgcaagcagcaccgggcgggccattttcaggtgagaaaaagcttccgcctgaaattgaagcaaatttaaatgcgcattatggcttggacaagccgctgtttgtacaatatgtcagttatttgaaatcagttgcaatgtgggatttcggaccgtcatttaaatataaaggtcagagtgttaacgacctgatcagttcaggtttccccgtttcatttactcttggagcagaagctattctcctcgctttagcgttaggtgtattgtttggggtcattgcagccctttaccataataagtggcaggattataccgtcgcgattttaacgatatttggtatttcggttccgagctttatcatggcggctgttctgcaatatgtgttctccatgaagcttgggctgtttccggtcgcggggtgggattcctgggcatacacctttttgccttcaatcgcacttgcttccatgccgatggcgtttattgccagactttcccgttcaagcatgatcgaagtgttaaacagtgattatatccgcacagcgaaagcgaaagggctgtcccgcccagcggttacagtgcggcacgccattcgaaacgcgcttttgccggttgttacatatatgggcccgatggccgcacaggtcttaacggggagcttcattattgaaaccatttttgggattccggggcttggtgcacacttcgtcaacagtattacaaaccgtgattatacggtcattatgggtgtaacggtgttcttcagtgtcatcttgctattgtgtgtattaatcgtagatgtgttatacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcgtacttattatccttatggcaatttttgcgccgatgttctcaaggtatgattattcaactactaatctcttaaatgcggataagccgccttcaaaagatcactggttcggaacagatgatcttggacgagacattttcgtccgtacatgggtaggggctcgaatctcaatctttatcggtgttgcagctgctattctcgatttgctgatcggcgtcatttgggggagcatttcaggcttccgcggaggcagaacggacgaaatcatgatgcgtatcgctgatatcctttgggcagttccttcattattaatggttatcttactgatggttgttcttccgaaaggtctatttacgattattattgccatgacgattacaggctggattaatatggccagaatcgtgcgcggacaagtgctgcagctgaagaatcaggagtatgtgcttgcttcacagacactgggtgcaaaaacatcccgtcttctgtttaaacatatcgtgccaaacgcgatgggttctattttggtcacgatgacactgacagttcctactgcgattttcacagaagcctttttaagctatttgggacttggtgttccggctccgctggcaagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggggagacgctggccattgttggagaatcaggttccggaaaaagtgtaacctctcaggcaattatgaagctgattccaatgcctccgggttatttcaaacgcggtgagatcctgtttgaaggaaaggatctggtgccgctgtccgaaaaagaaatgcaaaatgtccggggaaaagagatcggcatgatattccaagatccgatgacctctttaaatccaacgatgaaggtcggtaaacaaattacggaagtgctttttaaacacgaaaagatctcgaaggaagcggctaaaaaacgcgcggttgaactgctggaattagtcggtatcccaatgccggaaaagcgggtgaaccaatttccgcacgaattttcaggcgggatgagacagagggttgtcattgccatggcgcttgcagcgaatccgaagcttctgatcgccgatgagccgacaactgctcttgatgtaacgattcaagcgcaaattttggaattaatgaaggatttgcaaaagaaaattgacacgtccatcatctttatcacacacgatcttggtgttgtggctaacgttgctgaccgggtcgctgtcatgtacgcgggacagattgtagaaaccggtacggtagacgaaatcttctacgatccgagacatccgtacacttgggggcttcttgcatccatgccgacactggaaagttcaggagaggaagagctgactgccattccgggcacaccgcctgatttgacaaacccgccaaaaggagatgcttttgccctgcggagcccttatgcgatgaaaatcgattttgaacaggagccgccaatgtttaaggtatctgatactcattatgtcaaatcgtggctgcttcatcccgacgcgccaaaggtagagccgccagaagcggtaaaagcgaaaatgcgtaaactggcaaacacgtttgaaaaacctgtcttagtgagagaaggtgaatgaattgactgaaaaactattagaaatcaaacatttaaaacagcactttgtcacgccgaggggaacggttaaggctgtagatgatttatcatttgatatctataaaggtgaaacattagggctggttggtgaatctggctgcggtaaatcgacaacaggccgaagcattatccggctgtacgaagcaaccgatggtgaggtgctgtttaacggtgaaaatgtgcacgggagaaaatcgcggaaaaagctgctggaattcaaccgcaaaatgcagatgattttccaagacccctatgcatccctaaatccgagaatgacagttgctgatattattgctgaaggccttgatattcataagctggcgaaaacgaaaaaagagcggatgcagcgagttcatgaactattggaaacagttggtttaaacaaggaacacgcgaaccgctatccgcatgaattttccggcggccagcgccaaagaatcgggattgccagagctcttgctgttgatccggaattcattatcgcggatgagccgatttccgctttggatgtatccattcaagcgcaggtcgtgaatttaatgaaagaactgcaaaaagaaaaagggctcacatacctgtttattgcccacgatttatcgatggtcaaatacatcagtgaccgcattggcgtcatgtatttcgggaaactggttgagcttgcgccggcagatgagctgtatgagaatccgcttcacccgtatacaaaatcattgctttctgcgattccgcttcctgatccggactatgagagaaatcgcgttcgccagaaatatgatccgtctgtccatcaattaaaggatggggaaacgatggaattccgtgaagtcaaaccgggacattttgtgatgtgcacggaagccgaatttaaagctttttcatgatttatcaatccttcaagagaaatctcttgaaggatttttttacggcatcatagaaagtgagaatgatgacatttacaattagaggaaaaaagcggaggcgaaatacaattcaatttctgcataacaaaaatgtttttgcgctattgctgtctcaatctcttcaatctttagcaggagtcctcgtcacaatcgttttaatggtccgggtctatcaaatgactgactccgtttttttagcaagccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttctgtttttccttcgcgggcgctttttttcagccggcaagatttgcgctgctgccgattattgttccaaagaagcaatatgtaaaagcgaatggtgtaatctccctctcgaatcaattgttcttaacagcaggctggggccttggaggccttctgacgtacgccgtcccttttgaacccgttgtcggcgctgccatttgcctgtttgttctatcgggagcttccatcagtgtgctgcatgtaaatgaagaagaggctgtaggaactgctgaaacagcatctgccagaagtatatggaaggatttaatgatcatccctattgtaagagacattactgtaatggacatgatagaagctttggcgggttccgtatggtcatctgctattctcctcgcatttactgcggctgttttgcacgaaacagaggtgtggtgggggatgtttaacgcttcctattttataggcgcaattgtcggcagtgtggttgccattcgtttttcttctttttttgagcggaatatgggctatgccattatgttcagctcgcttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcgtcacctactccattatggggctagtggctgatgctgctggtgcgaaaatagcttttatcgcggctgctgcattatatatcatgacatttctgattgcactggcgcagccccgcctggttcattacaggcgggaaaatcgagttcaatgagaaacaattcaaaatgaacggagcagatggctcggtttttgctgaaaaaaaatgaaaccatggaggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttatcataaagatgaaggcaaacatcatattttaatgtttgcggaattcgattcttttatcttcgttgattatctgtatgtgtctaaggatgcaagagggcaggggcttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccaaaaacagaatcagaagaagaaattcttgaagccatgaaacagacatatgaaaacattcatacttataaagacgagaaatggtacggggaatcgtacgaaaaaacggatgaagtcctgaaactcattgatgaagaaaaacaaaaaaatattttcgatcagttaagctaattgagaattagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggctcgaggagcacgatattccatttgtagaaagaaatattttctctgaacctttatcaattgatgaaataaaacaaattcttcgaatgactgaggatggtacagatgaaatcatctcaacccgttcaaaagtattccaaaaactgaatgtgaacgttgaatctatgccgctgcaagatttgtaccgcttgatcaacgagcatccagggttgcttcgccgtccgatcatcattgacgaaaaacgtttgcaggtcggatataacgaagacgaaatcagacgtttcctgccaagaaaagttcgctctttccaattaagagaagcacagcgtttggcaaactaatagatcgtatcatcaaaagaaggctgagtcatcagccttcttttttagatagttgacaaaatcctaaaacggttttttgttttaggattttgttaccttttcagttcagcgtgattgaaaacctttgaagtctaggaaggccgagcattggagcacaacgaatatgtttattcgtgagcaccgacgcgcaggtctgacaaggaatgcaaaggtttgtcgacacgctgaaagaaggctgagtcatcagccttcttttatttttcaacctgctggtaataaatgctcgcaaggatgacaaacgcaaccgtcaaaatggggaggagcgtttcaactgtgccgtgctgcgccataaaaagagacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgtgtgaagctcccgcaactgcgatgacgttgtccagcgacataaagagatctgcaagcacaatcgttcgtatcgctctccacagggaggtgctgcttttaatgtgtttcgtgtcttttttttcaatcagcagctgatatcctaaatacagcaggaaaattccgccggcgcactgcaagaacggaatgttcaaaagatatacagctgcacttgttaatccgattctcatggcaacggcaataaatgttccgagaataatggcttgctgtctttgcttgtccggcaaatgtctgctggccatggcaatgacaaccgcattatctccgccgaggatcaggtcaatcccaacaatgacaagcagagaaatcagatagtcatgctccatgaagcggcacctcgctttcagtccttcgcttgtactactactatatgagacaggtcgtattttatgatatcagccgcctgaactgccgttttttaggcaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaactattctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaaattgaacgttaacggaagcaaaacgactttatattcgtttgagaaccgatattatttatatgtagatttttgcaatatgactgatgaagaggttgaaaatcagctaagcatcctgctggagtacgcaactgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgccattttagagatgtgaaaaatcaaaaacatatagacaagcagaaaatacagcgaacaggagttgatcatcttttccagaaagtatacttcatctggaaaggagagatgacaattgtttagtgctgtgactgaagacggccaactgtttcaccttctaggcgctcagcaaaaccagaaattaaagcggagacggttcttctgtccggtatgcgggggagagctagctgtgaagctcggacttcaaaaagcgccgcattttgcccataaacagaacaagtcctgctccatagacatcgaaccggaaagcgcctaccacttagaaggaaaaagacagctgtatgtatggctgaaaacacaacgggcttcaccaatattggagccgtatataaggacaatcaaccaaagaccggacgtcatggcaaggatcaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcagcttttcattggcagtttatcaatgcaagtccatacagagagctgatatgttattgtcctgaaaggcgttcttttctccggctcagccacatcattccattctacacaaaccattcttattcctcagtccaaacgatccctatccatcgggcaggtgcagacgatctttttttcactgaaccgaaaccctcaattcaatattcaggctggacgaaagcgattcaccgttttcgccataaaccccatcggtttaactcaaaggaaacaaatcgccttaggctgctgttttatgagaagcggcagacgcctttttcttttctgccgactgaagtgtttgttcctgttagaaaaggggcagtttttaagagtccggtttttgtgtggcaggggtttctttatttgtttatgacggatcttggagataaacgtgcgccaattcgtttttcagccgttttgcagcagtgcaaactgcacattcataataagaacattgcactcaggttcgaatgcagcgaagagtgtctttcagaagcggttaaacagtatattgattttttgtgcaagaagggatttttaagggagactcagaaagaagtatatgtactgaatcagcctgaaggcggcatacactcaatgcaggatctcatagaaagagaccgcagctgttttatagaatgagtttgtcttatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctctgaccaggatactgggaactccttttaccaggggctgaatgacaaggcgggaaacctgtatacacaggccgcaagcgcgacagcttatttggttccggagattttatccatagaagaagacaaactgcagcagttcattcttgaaaaagaagaattgaagctgtactctcatgcgattgaggagattacaaaggaacgtccgcatgtgctgagcgagaaggaagaagcgctgcttgctgaagcctccgaggtactggggtcatcttcaaatacattcagcgtgttaaataacgcagatattacgtttccgtccattaaagacgaagatgggaatgagaaacagatcactcacggcaactttattaatttcttggaaagtgaaaaccgtgaagtccgcaaaaatgcgtttgacgcagtgtataaaacgtacggacaatataaaaacacaatggccacgacgcttagcggcactgtgaaaaaggacaacttctacgcgagagtgaaaaagtacaagtccgcgcgtgaggctgcgctttctaacaacagtattcctgaggaagtatacgataaccttgttaagacgattaataagcatttgccgctcctgcaccgctatattgcgctaagaaagaaagtgcttgagcttgatgaagtgcatatctatgacctgtatacaccgcttgtgaaagatgctgggatgaaggtgacatacgaggaagccaaagattacatgctgaaaggcctcgcaccattaggggaagaatatgcctctatcctaaaagaaggcctggaaaaccgctgggtggacgtttacgaaaataaaggcaaacgcaatggggcttattcatcaggagcttacggcacgaatccgtatattttgatgaactggcataataacgtgaataatctctttacgctcgtgcacgagtttggacattccgtacacagctactatacgagaaagcaccagccttatccatacggcaattacagcatctttgtcgcggaagttgcctctacgacaaatgaagcgctccttggcgaatatttgctgaacaatttagaggatgaaaaacagcgcttatatattctcaaccatatgcttgagggcttcaggggaacggtcttcagacaaacgatgttcgctgaatttgaacatctgatccatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagctcacaatacccgattgatgtcctgaaaaaagcgggtgttgatatgacgtctccagagccaatcgaagccgcgtgcaaaatgtttgaagaaaaacttgatgaaatggaagagctgctgatgaaagtcaagcagtcttaaaaaagtaagcctgtgcggaaatgacgcacaggcttttttaaaaccctttaaaggttttccggtgattcaagcggtagagggtaaacaaaatagacagaaacagcagaggagaggtaatataaagcggcagcatatgcatcatgcctaagatattcagacagaaaaaaacggcaatgcacacaattgagatcaaagtagacatcatggcgatcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagcgttaaaattagaacgtatgtttggttcagggcgtaaaaaaacagcctcaagcatatgcacgcctgcggctatttttcacatgattgatattcatcagaataagtgctgagagacttccaaaacattccgtgtttggcttccactttggcaacctttttagcaaacgccagttttttcatttctttttctacctcttccaagctcaggtcatatacaagagcaatttccttcgaggcaacgaagcggaaatattcaataaaacattctaaaggcggtgtttccgacggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcgctttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcgtccttgcaattcggctgctttaaaagcgagagcagccatataaggcgatgaaagcggctgttcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtccattgcgtccttcatacagctgagccacgcatcagctctctcgtttgtaattggaaagggaagatgccttgctctgagcataggatggccgtgttcctcagtataaagaggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctaggtttattttagcaacaaggcatcatttctacaaacaaactgccttttttgcgtatgatgactcatttcggctgacagccggggtttgtatttcatatcatatcacataaaaatcaggaatgcgtaagatttcacttcgcaaaaaaaccagaggggaagccctctggttacgcgtaataagctgaagttattttttttacatagttttgcgtttcttgaaaaggaggaatgcctccgtatcggtcaacattccccggtccggcgttgtaagccgctaatgccatagacacattgccgtcgtatttatccagcatttgttttaaatatttcgttccgccttccacattttgttgtggatcaagcggattggaaacgccaagtgagcttgctgttgacggcatcagctgcatgaggcccatcgcacctgctccgctgaccgcttttgcattaaagcctgattcttgtttgatgacggcacggatcagtttttcatcaacgccatatttatcagcggcttttttaatcgcactgtcaatagagaagttacccgaactaatctgatttgcttcgtgtttgtttgaagctgaatctgcagcagctgttttagtgctttctgccgcttttgtgattgaacctgaattgctgctcgtatatgagttaagcccatacgctgaaagcagtgacggcgctgttgtattcgcgttgttcagcatgctgagcgggcttggcgatgaagaaggtgctgattgctgagatgccagaccgtttgtatattggctgagcaaagaactgaaacttgaaagcgggctttccgtattctgagtgtccgagctgctgcgtgcattagatatggactgtaatgcctgaagctgaagtaatgctgcccaattcgttacattcacgatgtcattccaccttatatagactttcgtttttcttcataaaaacgcagaattttatttttggtttcgcgctgaggaatgctgaattgctgaagcagcttttcgaaggcttgtctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacagggccctcgggaactgaaaatccagcgagatctgatacctctgaaagctgctggtgcgtttccagaagccccacatcagccggctcctttaatgtaaggacatactttccgttttttctgcggatacgaagcgcagcatgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatttcttggctcatgatgctcttcctttccgccctgtaaatcttatttttactattatctctttagatgttaggtttatcaatatcgagctcgatatgataaaatgaatctgtactttgtttaaaaaaggagagcattatgcaaaacagaatcgaaattttgaatgcaacattatcggatgatcagcttcgccttgcctgtcagacagaaggaaacgaagcggaacgcaagccgtcaggtcaaatgcttgttgattctgaccactttgcttttgtatacatacttgaattagctgattcttttgaatatgtcattataaaggaacatgtatggccggaactgaagcaggcccatgcacaaaaaataccggttgttttagaggcaggaaaccaaacaattgaactggcaggcctgcatgaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtaccgccaggctgtcgaagagttgaaagtgaagctcaaggggatccgcacactatatgaatacgaggacgaccattcaccgatcgaatttgtgaccggacgcgtcaagcctgtggcgagcatacttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccggtcataccatctagttgtgctgtaccctttgcagacggtatccggagaaaagcatgttctcgtggaaatacagatccgtacactggcgatgaatttttgggcgaccattgaacattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaagggggagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgccgactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccggggcgacggcctctgcctgtcaactccatcaggcagcacagcctacaataaggcgctgggcggagcgattatccatccgtctatcagggcgatccagcttgcggaaatggcttctattaataaccgcgtgttccgtacggtcgggtcacctctgcttctcccatcccatcatgattgcatgattaagccgagaaacgaagttgactttcaagtgacgattgaccatttaacccttctccataaagatgtaaagtcgatccgctgccaggttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaagaatatgccggtgaactgggaatttcgaaacgtctgctgaccgatattaagtttggcgggggcgacctgcagattaacggtgagcatgtgacggtcaaatacgttttgaaagagggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgctaatggaattattgatcattatcaaacaaccggagtgagggcgacagttcatcttgtcacccggttagaccgggatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtataattgaacggacggtaacgccagacggccagaaggctgttacgcatttttacgtcacatgtgcaaatgacgatatgacctcggtgacgttgcagcttgagactggacgaacccatcaaattcgtgttcatatgagttatctcgggcacccgttgtgcggcgatacactgtacggcggaacgagacaggaaattggccggcaggctctgcacagcgagcatctttcgtttatccatccgctgacacaggagaacatgacgtttcatgctccactgcctcaggatatgagaaaactgataaaaggagagaatcattgattctctccttttttatatggggcgaaatcttgattcgtcgtaaggcagggagcttggaacagagacggtttctatttctggaaagcgaaagcctgtcagttgatttccgaacacgcagcctgtatcaatgttgatggtgcgattgaccttccgaggctctttcacaggtgtatgaccgtataccacccaagcctttccgttataggctgccgcccaatcacgtctgacgggtctgccgtccggatatgtttcacccgtcacgtcaccgtaaagcacaaagtccttcactctccgggtatatttgccgatatcgtcagctcttatgccagcatgggcgacaactaattctccattatgtaagatgtcgtaaagcggcgctgtttcgtacagcttcataaactgttcgctgactgattttctctcatctttagaaagttcctcaagctctgccgctgttgtttcgagaccatgcatcacttttaccggatttccttttaagtaacgatataatttattgcaatggtttcccgggacataacgcacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtatcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgagaactagcataaccctgacttaaaaaggaggttctgattatggcgcatacatctgtcgcatcattagttgttgtacttatcgttgcatttttgacacccatccttttgcatcggtttaaactcagcatcccggttgttgttgctgaaatcattatggggctgattattgggaaaagcggccttaatttagttgtggagggtgacacctggctccaaacactctctatgctcggatttatctttttgatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcagccggagtggtgctttactttttcggccgggtctttaaacatcgctcttttgtgcagtccatgtcaaaagggacgatccagatcgggacgcgtgccatttttacgttaattattgtactcgttgccctgtctgaatcacttggggcggaaaatattctcggcgctttcttagcgggggttctcgtttccctgctttcgccaaacaaagaacttgttcagcagctggattcatttggttatgggttcttaataccgattttcttcgtgatggtcggtgtgaagctggatatttggactcttttccaggataaaacaattttaatcatgattccgctcctgctgctggcgctgttagtcagcaaaatcattcctgtcatgtacctaaagaagtggtatgataaccgaaccattttcgcgtctggcttcttgctgacatctacgctttcgctcgtgattgccgctgcaacaatcggccagcagcttcacgtgatcagcgcaaatatgtcaggagcgctcattttagtagccgtcattgcaagtatttttacgccgatctgttttaaaaaattatacaaacgggaagagcagccggaggagaaaaagacgattacgttcattggcgccaatcaaatgactttgcctgttacactcgaattgccagaggaagagtatgacgtgcgtgttgtacacgtctatcaagagaatgcggaggaaaagctgtcagaatcagtgtttgctgttgaaacaatttctgactatgaacacgagacgcttgaatcactcggcatttttgaaacggatatcctcgttgtggcgacaggaaatgaagatatgaatgcagacattgctttacttgcaaaagaaaaaggcacagaaagagtcattgcaagcgtaggatcaccggagcatgaagcagttctgaaggagcagggaatcagcatcttttctattctgctgtcgacaaaaacgctgcttcgcgcactgattgaagcccctggcgtcatgaagctgctcacgaaccaggagtcttcgctgtatcaaattaatatggagaacagtaaatacgacggtgtgattttacgggaattccctttaacaggtgacgtcatctttgtcaggatcttcagaggtgtggacagcatcgttcctcatggggatacaaggctgaaacttggagaccgtttaattgtcaccggatctcgggatacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagagggggaatgatttgtgaagttttcagaagaatgccgcagcgcagccgcagaatggtgggaggggagctttgtccatccgttcgttcaaggaatcggtgacggaacgcttccgattgaccgttttaaatactacgtacttcaagattcctattatttaacgcattttgcaaaggtgcagtcatttggcgcagcttatgcgaaggacctttttacaacggggcggatggcaagccatgcccaaggtacatatgaggcggaaatggcgcttcatcgcgagtttgccgagctgttggaaatcagcgaggaagagcgtaaggcgtttaagccgtctcctacagcgtactcttatacatcccatatgtaccgttcggttttgagcgggaatttcgcagaaatcttagcggccctgctgccatgctactggctttattacgaggttggtgagaaattgctgcattgcgatcctgggcatccgatttatcaaaagtggattgggacgtacggcggtgactggtttagacaacaggtcgaggagcaaatcaaccgctttgatgagctggcggaaaacagcacggaggaagtacgtgccaagatgaaagagaattttgtcatctccagctactatgaatatcaattttggggaatggcctatcgaaaagaaggctggtctgacagcgccataaaagaggtggaggaatgtggagcttcacgccataacggatgacagcaagccggtagaagagctagcgagaatcatcattacgattcagaatgaagttgattttattcatattcgggaacgttcaaaatcggcggcggatattttgaaactgctcgagcttatttttgaaggcggtatagataaacgaaaactggtgatgaacgggcgcgtggatattgcgcttttctctactattcaccgcgtgcagctgccaagcggcagcttttcaccgaagcaggtcagagccagatttccacaccttcatatcgggagatcggtgcattcactggaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcgggggatgacgccggacaggttaagagacgtaaaacaagcaggggcagacggcattgctgttatgtcaggaattttctcttccgctgaacctttggaagcagccagacgatattcccgcaagctaaaggagatgcgctatgaaaaggcattatgaagcagtggtgattggaggcggaattatcggttccgcaattgcttattatttggcaaaggaaaacaaaaacaccgcattgtttgaaagcggaacaatgggcggcagaacgacaagtgccgctgccggaatgctgggcgcccatgccgaatgcgaggaacgtgacgcgttttttgatttcgccatgcacagccagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgtccatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggcaaactggttgtcggcgcgacaatgaagccgggggactggagtgaaacaccggatcttggcggattggaatccgttatgaaaaaagcaaaaacgatgctgccggctatacagaatatgaaggtggatcgtttttgggcgggactccgtccgggaacaaaggatggaaaaccgtacatcggcagacatcctgaggacagccgtattttatttgcggctggccatttcagaaatgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcgtatcagcttgaaaataaaatcgttatcgtggaaagaaataaagaaataatcgggaaagaacgctatcacgaggttgagctttgtgatcgtgatgtcattgaaattgtccattttgtaggaggcggatgagcatgttaacaattggcggaaaatcatttcaatcaagattgctgctgggcacggggaaatacccatcgtttgacattcaaaaggaagcagtagctgtttctgagtctgatattttaacatttgctgtaaggagaatgaacatctttgaagcatctcagccaaattttctggaacagcttgatttatccaaatatacgcttttgccgaatacagcgggcgccagcactgctgaagaagcggttcggattgcaaggctggcgaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcaggacaaggaatcttaaatcctttgaatctgtcgtttattattgaacaggcgaaagtgccggtcatcgtggatgctggaatcggctcgcctaaagatgcggcatacgcaatggagcttggagcagatggcgtactgctcaatacggctgtatcgggagctgacgatcctgtgaaaatggctcgtgccatgaagctcgcggtggaagcaggacgcctttcttatgaggcgggccgaatcccgcttaagcaatacggaacggcaagcagtccgggagaaggtcttcctgtatgacgggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctctgaaaattgccgacagagattatgttgaatggagcaacctccagcgccagcagctttatacagaagatgatgtcaaaaaagaaatgccgaaagcagccgctgcggagcgccgtctccgttcgattaacagcgatgttgatgtgaccggccttgtcatggatgtgacagcagaaaatatcttcgagctgattagggatgcatcgattattgtggatgcggctgataattttgaaacccgcctgatcgtaaatgatgctgcggtaaaggaagagattccttttctttacggtgcctgtgtagggagctacggcctcacctttaccgtggtgccgggttctactccttgcctgcattgcttgctcgatacacttccgattggcggagcaacatgtgacacagccggcatcatcagtccggctgttttgcaggtagcagtctttcaggtaacagatgcactgaagctgctgacgggagaggagtgcgagccgatgctgcgctcctttgatttatggaaaaatgagcggtcagaagtgagagcagccagtctcaaacatgacgcatgcccaagctgcggcacaaaggattttccgtttttgtcatatgaaaatcaaacaaaagcggctgtattgtgcggcaggaacacggtgcagatcagatcatctattacgaaagaagcggatcttgaagcgcttgccgctcagctgaggcaggccgggcttgaagtagctgcgaacccgtatttaatttcctgccgctcggatgatatgaaaatggtgttgttccgggacggcagagctttgatccatggaacaaatgatattgcccgggcaaaatccatttatcataaatggattgggtaataaaaggagtgtagtgtaatgagtatatataaagcattgacaatcgccggatcagattcaggcggcggcgcagggatacaggctgatattaaaacctttcaagagcttgatgtattcggaatgtctgcgattacggcggtaaccgctcaaaatacgcttggcgttcatggggtgcatccgctgactgtagagacgttgagacagcaaattgacgctgttgctgaggatttgagaccggatgcagttaagacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcagagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcggctttaacggcccaaacggctaaaggagacagcatccatcaggcatttgaggttgcggccaactttgtccgtgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaacaaacgcagcatcgcctggggcattgcgcgttctttacatgaagcgggtgcacgtttgattttcacatacgctggtgaacgcctggagaaatccgttcacgagcttgccggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaagaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgtcatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattcaggtttccatatcactgcccgctaagcaggatctatatcaagcaatcccgaatagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaactacaaggtcatccatgcaggagattgtcatcaaaagaaaggccgacaaacccgctccgccaaaagctgaggaaaagccggcttaccatgagaagcagcaggaggaagccgtggcacaggatgtcctgcaagaagaccaaaagcctgcagccgaaccagtgagtcagcaaatacaagaggtgagagagccagagaacataaaaagccaagaggaacagaaagcagagccgcaggccgtagaagaaaccgttgaacacgagcccccgaaagcagaaaaaaaggaagagcctgcacttgaggcccggaagcctgagaaagaaccggaagctgtccatagtgccgataaagcggaggaaaaagcacctccggcacgaaaagtgaaaaaaccgatgagcaagatgacgatccacgaaaaaattgattttttaacaaagctgcctcataacatgccgagagcgctttgtttgattgaagccaatggaagaacgtacaggggcgtaattgtcggaagaagaaatgattccgtcctgcttcgaacaacaggaaacggagccccaaccgaactggcaatcgatgatattacctctttgcacccgctcggtttttaacgaaaaagaaaaaagctgcccggctgatgttgccggacagcttttttacatagagaaaagcctgcaggcctgcaagcttttccagcttatgattaatgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcaaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgctggaagcagctgaatgatttgcacctgtaatagagtttggaaggggattcctctttacaagtgtttatccattgtgatgatgctttttatctttatgaggcgatgttctgtcaactagctctggtgacaggcactgaatcgcgcagaagcatccgagatcgacttcaatgcagaaatctgttttttctagcccgaagaaatccgggtcgcaagggtggcaaacacttaaggtatcgcctttgacatcgaccgggcgtaaaatagaaagtgttgcacagcaatcgcataatttttcgacgcggaagaaaatggattcaaagcattgcatatcatccacaaatccccctacgtttccgaatgtggagaacaatccgccttttttatcaaaaacgagaaacggaattgtgtcttttccagcaatcgtagggtttaaaaggttggtatagcagccagtcggacactgttcttcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttaggttctagaggacaagagtgataactaggatggctacgagtgtatttgttgctgtagagataagggttgcgatatcggcatctactgttgtgacgtttacgccgcgggaacattcgatgagaagtttttggcgatttacttgtttgttggctgtaagctgtaacaaatcttgtgcgactaattcggcaattacgccgtctgcaattgatgtcagagttgccgttacgacagcggcattaagtgctgttacaactgatgttacggcttgaacgtctgtagatgtaacattgatgtcacaagaatctctaataataatcgtttcatctgatacttgtttgttgagatttgcttgagctagatcttggtcgatgaaggcgttgtcgttgccaaaaaaaccattgccattacagcaaacgtcgcaatgacattttctttcgtgtttttctttatctttctctttgtcatctaacggatggtcacagtcaggatcaagtgcaacccaagaatatggtctgctttccatatctattcctccttttcttttactgttattaaatgagcgagcctcttattttgactgagtcatatatcctgatgaagaaccctatttttttttatgattggctaattgttatcgtttttccgtctttgtctgatctgttcaatgagctgctctctgcggcttagcggttttgtgttttgctcttgcacggctgcttcttcttttttcttcttttggttttctattagcgcttgtgatttagcttgtaagtcttttacaagatttaagagcatttctttttcttcgtctgatacttttttcattttgtctttcgtgacaccatgtttagaaaatatattttggaccagcattttcgtcattggatcaacttctggaagctttgcaagctcttctttgaatttatcgttatctgacatttgttttcacctcgtcttttaagtttgtgaaaaagaaagggttaaaggacgtcaagttcactaagaatgctgtttaacacctgaagcaagatttgtacaaaggttattatctcgtcggcagacaaagtaattttgatgttgcggctgttgataattttaatgatggttctttttttgatttgtgagctatcgagaataagaatttcacttgccactgcgtcagccaaatcctcgtcggcgatgacgagctgagtcgccacgataatcatggttgtcacaaaggcttgtatagaaagggcagctgttatatgtgacgtgtcaattgtgatattttcgcaatcaatcacttcgatctgctgttcgaattcgcttgataattgctcaaatattgcagggtgcagggattcgactttttcttcaaatgacataaccttcactcctttcttatccatactctatataatgcaaatggggtgcagagcggaataataaaaataaccaattttctgccggacaagatacaattcatgaagaatagggttttcgcatatatgtgaagggatcatgattggcaaaggagtgaacgagtggttataaatgggctgacaatagttcttctatcgcttgcggtctttcggctcgcccgcctgcttgtgtttgacacgattatggcgccgcttcgcagtctgtttcatgaagagaaggaagaaaaggatgcggacgggaatattcaaacctatatcgtgattaaaggaaccggtgtcagggcgtttattggtgaattgctgagctgctattggtgcacaggcgtgtggtgcgccggctttttgattttatgccaggcgttgatcccgcaagcggcgcagtggctgattttacttttggcgatcgccggccttgccggcatcatagaaacgctcgtatcaaaatggctgcaagaataaggcgttaccaccagcaactttctgtcagaatacgcataaagtagcatatatgacataaggaaaggaaggggacaaaaatgaatcaacataataaaccttcccaaaaatctccatatacagattcatcgtatcaatcaaaaaagataaaaaagaaaggctgcgggtgcggaaataaaaagaaaaagcctcaatagcctggcaaagaaaccggagaactccggttttttgtttttttaacggggcggcctcgctcagcatatatcataagcggggggataaaagtgaatgagtttgaaaaatggatagaaggaagatatgaaccacacgaacaaaagcaaaaagagtatgaagacacgatgggccgtatcagaaaagacttggatgcatttgataaagccggtctggaatttgaagatgagattgaagagctggctgaaaaaacggaggccttacttaaaaaacatcaagctcaatatgatcaatcgtaaatccgcaaacgccctatgcgaatatccaagccgatccaagcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttatttttaaaaatgttggaaaagcacattgtattatgtgcattcatacaataccgtattactccgccaaaaggaggcgcattatggataatcaattttttaagaacatcgaaaagaaaacaggtgtgaagatgcaggatgtaatgaatcttgccggatcactccaaaacgctaattttaaagatgaaaatacagtgcgcagtgtgattaaccgcgtagcgcagatggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagtaatctgccgggctgttaatgatgcaagggctgtcttgctttctgtagcaggggatacaaaaatcttgagcggttggctgttttgccgcgcctgttagcggggcaagacaaatataaatgctgtttcgcccgggtcatggctacatataaaaggcgtctttcctcctcaagagcggcttcgtctccttttcttgccgtttctaatgagaaatcgtgcggaatcgagccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatgtcgcgcaggtcatcggaacctttttccagcttgttgccctcattgccccgcttttttaaatactcggagaagcccatttttccttctgcaaaggtgatggcttctacgggtttcattgtgcggaggcttgcgaaaaacggtacgattttcttgattttgtccagctggaatggcttcagatcaggcaatttggccagcgctttgatcatggtacagtcctctgtaatcgagagcgccttcagcgtattcaaagcggactgttttaaaaacaaggcgggaagcaagtgtttaatcgcctcggtgtcatcctcattttggctggcatacaagtaggcgagaatctggcggacgatccgtctgctataaaacgattggacgccgcggtcagctgtatacggaattgatgattgatgaagcctttcataaatagcacggcctccgctgtttgtgcggtaaagaaccgcaaagtcatctggactggctccattttgaattttttctttgatatcggaaacgaccattgtggcttcttcctcttcatcataaggataaaacagcacagggacctgaatgtcatcgcgggccgcttcaagcgttttggcatatctgtttttgttctttttcacgacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccgggctggcgagcatttgcatgattttgtattgaaccgggttaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgctgcagggcttggtcaactgggaattctttctcatcgatgccctcttcatagagtgcttttttgatatattgttcccgctgccactccattttcagcagatgctcaccgttccatttagcagaattagagtgatacaagatcttataaaacagactgtggaatgttcctgtcacaagtcttctgacttttgccggctgtaatccgtactggttggccatacgctctttcatttcagcgacagcttttgttgtaaaggtgacaagcagcatattttcaggcggtatgcctaagtgttcgatcatgtgggcggcacgggctgtcagcacccgtgtttttccgctccccgcacctgcaagcacaagcagcgggccctctgtttccgtgacagctttcagctgatccgtgtttaaaccgacagacggaaaaaggctcgtatcgggttttattgtttttggcacaaatggtgttcctggtttaatgcttctaggacggtgccattccgtaacagctggggacgggtcagcggcgatcgcttttcccttgggtaaacgaatgacaccagattcctgatcgtcttcttttttttcctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtatgattctatcattcagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggccgctgaaagaaaagtaaacgagatgaaacgtaagcgctctctttataagaggttgcgagaaaaaggaatgggcacatatattaatcgatatgtataaaaaaccgttcataccagagaacggttttttatatgcgaaaaaaatccggatctcaaaagatccggatgcgttcagtccttcatcatttgtaagtgcggaatgccggcatcgaggaattctttttcagaaagcatgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcaccgacaggcttttcaccgtcatacacgacgatatgctctgactcattttcaagttcgtcaatttcttcttcagcaggcacgttttgttctttgacaaagacttcttctcttacatagaatgcatctttcaattgttcttcattttttgcgataactgctttcaaacattattctcctctgcctagcaagaaggtttcatatactgtccacgatccgttttccagctggtaaagcaagtggaaacggtcaacgatttcttcatgcgacacttcctgcatttttaattgtcccagcacatctgaatgctcatcgtcggaaagattttggccgaccgtcacatgcggaacgaaattatattcctgttctcctgccaacacaccggtgtatagcttttcattgagtgtttttaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatggggcgggatcagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcaaaataataatcggaaagcttcttctccagcagctgtttcagctcctggttcggttctgtaaagtccagaatgttcccgtctgtcgtgtggacgtcagtttcttttgttccaatttggtgataaatagagaggtgtttgatatcatctgactgattcacggcttctagtatatgtttgtcaacatagggagactgcatgatgatgttgccaaacatattcggataatcaagcgctgtcataagtgatacggtcgctccgagcgaatcaccgatcagggttcggccataaccgatctgataggttggatactcatcatctgcaaaaggaacgagctcatgggcgatgaaccgtttatacgccgaaaattttgaaccctccggatgataggtgtttctgcgctcttttacatccttatagggaacaccgataataatgcaccggtctatttcgtgtttcgacagcaattcctcaacctgtctgccgattctccccagcctgaaataatcgtggccgtcctgcgcgataatgacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggaacacgaagaaaaaagtgttgaaataaactgtgaattgcgctaatataaaacaatcagaaaattgaaatcgatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagcccaaattgggaaccgtagcgatgaagtcacgggaacagtgagtgctcctatttatttatcaacagcataccgccacagagggatcggagaatctaccggatttgattatgtccgcacaaaaaatccgacacgccagcttgttgaggacgccatcgctaacttagaaaacggcgcgagagggcttgcctttagttcgggaatggctgctatccaaacgattatggcgctgtttaaaagcggagatgaattgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaacccctcatgcaggaggcggacattgaacatattgcccggattacaaaggagcacggtcttctgctgatcgtagataatacattttatacaccggtcttgcagcggccgcttgagctgggagctgacattgtcattcacagcgcaaccaagtatttaggcgggcataacgatctgcttgctggacttgtcgtggtgaaggatgagcagcttggagaggaaatgtttcagcatcaaaatgcgatcggcgccgtcctgccgccatttgattcgtggcttctgatgagaggaatgaagacgctgagcctcagaatgcgtcagcatcaggcaaacgcgcaggagcttgcggcgtttttagaagagcaggaagaaatttcggatgtgctgtatcccggaaaaggcggcatgctgtccttccgtctgcaaaaagaagaatgggtcaatccgtttttaaaagcactgaagaccatttgttttgcagaaagcctcggcggggtggaaagctttattacataccctgcgacccagacgcacatggatattcctgaagagatccgcatcgcaaacggggtgtgcaatcggttgctgcgcttttctgtcggaattgaatatgcggaagatttaaaagaggatctaaaacaggcattatgtcaggtcaaagagggagctgtttcatttgagtaaacataattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctcttgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgactcggtttggcattgagcatacgtttgtcgacatgacggatcgtagtgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacgccggcactgcagcgtccgcttgatctcggcgtggatattgtacttcacagcgcgacaaaattcttaagcggacacagcgatgtgctctcaggtttagctgctgtcaaagatgaagagcttgggaagcagctgtataagctgcaaaacgcgttcggcgccgtccttggcgtgcaagattgctggctcgtgctgcgcggcttaaaaacgttgcaggtccgtttagaaaaagcgagccaaacagcgcagcggcttgcggaatttttccagaagcatccggcggtcaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactgccggtcttcgctgtcagccttggcgccgtggaatcgattttgtcctatccggcaacgatgtctcacgcggcaatgcctaaggaagagcgtgaaaaacgcggtatcactgatggcctgctccgtctgagtgtgggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcgaggacttgatgatcctcccaaacgccattaattttcacattttttcgggcgatgccttctttatgaaatcccgctttttctaaaacacgcatggacccgagattacggggcatcacaccggcttcaatccgatgcagtttcaattcgtggaacgcataatcaacaaccaatctgactgcctctgtcataatgccctttccattatgggctttgtctaaaaaatacccgatgaacgcagtttgcagcgcgccacggatgatttgaaagagcgaaaccgtcccgattaatctatcgtctgacgctgtaaagatgccaaaatgatattcttcatctttctcaagtctttcctgatactcggttattcgttttctttgcccctcaaccgtatagtaatcgtctgcgcgtatcatagaaaactgttcgaaaaaatcccgattttcgctttgcagccgcaaattttcttcggcatcctttccttctaaaggtctaacataaatggtttttccttttaacatacagtgatctctccgttctcatgtcagcattcctcttacattattctcagggaaatacaaatatcctttttataagaaggaagaaaaccaatttccaataaaagtgccaacatagttgccgattaagtagccgagcgtaccgacaagcatgatcggggcgacaagctcccgccatcccttggcaattgccatcgcagccgcagtcgtcggtcccccgacagtagcgttgacggcgagcagaatttcttcaagccgcacgcggaacaattttccggcagctaaggaaactgctaaattgctgatcgcaatgataaacacgaataatagaataagaggcgcattcgtgacgattaagcggagatctgcaggaatgccgatcaccacaaaaaacaaataaatcaaaaaggttccaagttcctgagatccattgagcctttcaaaaaaacgcgggaaaagaaaaatgataagaacagttaaagacgtaagcaccaggtactgatcgccaagcgtaccggtcagcaggggatgagaaaaaatgcttttaaaataaccggaaaccttcatactaaccgcaacaagtgcgaaagcggcaccggcattaaaagcgatatcctttaaggaaatatccttccgtttccaatagctttcagcactgtttccgctgttttcatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccgccgattttatcgagataaggaatatgctgtttgagaagaaaaaaagctagaatgctcccaaggacagtgccagcggagctaatcagaaaaataaacagcaaacgcctgctttccttaaaaatttgccgaacattgatctgaaacaataaaagtggtatcgccagcggcaccacataagaccacacagtatcatacacaggcgactcaacaggaagcactcctacatttgtaaacaccatagcacctgccagcgcgataatagcacccgacacagcggacgcccacttaaagcgctgctccagcccgatgctcactgccgcccacaccgcaataaacccccacaatacccatgcatcatcagaagaaatcaaagaatgcaaaaccccatcacctctattgttagaaaattaagacatattataatagccggggaacggaacagcaagtccaaaaaaagtttttctaaaaaagcagttgacgaatagaagggaaggatatataatagaacttgtcagaaagacaacaacatacccagcaacacatacatatcatgattccgtagctcagctgggagagcgctaccttgacagggtagaggtcgctggttcgagcccagtcggaatcatagcttaaacccttgcgtagcaagggttttttactttgcttatttattgattttgtcatcattcatcgagttggggacgaattggggacgaaattaattttttgagctgattttgaaggggaattcaaaatcaactctgtttttgtgttaggtttctaggatcaaactggttaaagtgttttactgtgctattttcgagtttctcgataacgtgaccataaatatcactagttgttcgagcactggcatgtccagctcttcttgaatagcactgagactttcgccagcttccataaggagcgccaccatagtatgccgcaagtcatgaagacgaacatcttttaggccgtactattttttaattttagtccattttgcggtaggggttgtatagtagtaaggttttcctttaccactgtgaaatacatattgatgttctccgccttcccaggcatcgccaagcaacaatttttccacttgtttcctaaaaagacaatcaagcgcttaagtaattatatcttcaatatccaattatctattctatcgtctctttccatattaaaatcaactctaaaaactcatcagtttctataatactttcaaaaggctcatcaacccggcaatgatgctcagctattgtcatgtttttcttaattattatacttgtagcattcaacgtaatttcaaagtcttcataatctcctgttaaaaccttcttaacgtatccaatatactcgtctgcttcctcttttgttgaaatatcctcaaaaacgtccgagaaaacagttaatttttccggtagtattattcttgtgataccaaatggatcttttttaaattcatatgaatatctcatcttgtttttcaccttctatgctatttattatacaaaggataagcagtggctattgaaccatccttatttaagaacatttctattttaattcctgttgaattttcacctataaacttattagcacctatcttttttttattttgatacgcttcatcaatagcctttaacacatctacacgattccattccttcggaaaaaaactagatttggctatttttctcttcccactgatttcaacattggcttcatagacaccatttttattggtgttttctcggatccaggtataatttttccacccatcatactttcatgatgatatccaaccgctttaccgcgtctattaattcaccatggtaaatgtgttttatcgttcccgtattatatttacccgtatccttattgttagaacgttcagatcttctgagaacactctcttttttatcttctgcaatgctttttagcagcggaatatttttcacgttaatggttttctcagcatcttgaaggattccttctaatgcaggagtatatcggttaacaggagatttgacaaactgttttacggactgaccacctttcaataacagaagacttccgcccaaataagtaacatagtgcagccgtgtgtatgcatccccgtgtatcatttttgtattccaattatccttcaatgtgtcaaccatactttgaaaggcagcttgatagtcgtattccaaaacggtatccagcactttttgaggatccttgtttaagttatcaattgtccaactgatattccatccgaattgaatagctccttcaccggtatccttagcaagatcgtataaaccaacaatcgcacctttagcgctatcacctatgatttgcaacacttcttttccgttattcatgaaagctttacgctgttcaaggaataaaacaaattcaagctgttcaggggtaagattctcatatccgactttcttggcaatttttaagtattcgtccggatccgtcactccgtcagctagcttcttctttagctctttgatttctcgttctttcgcttcatctttcttgatcttcaaataagcttcagtctgtttctcgatatcgccttttttcttatgtatatcactttctcgataagctttggtattgtaatggattggtgtagcattcttgcctttgcctgtggattcctcaagtttttggaagtctttcttgatgaattgctcgtttggctctgactgggcatattcagtaacaagtgcttcgtccacactacctagtttgtcgactgtttttttgcgtttgtcctctgcatctgcaagttcgtctttaaagtcttcagttgaaaacagatcaagcggaaggatatcgtcgatattatgtaagatatctttcatggctttcttttgttcagacataatagattttgattttgtgtaggcgttagccagctcgtgttctaagaaggattcttctatataagcatcagataagctggcgtcctctagagtgcctgaaatgcttgtcaagaaagcaattttcatatcaagtaagtcaatccaattgtcagctacacctgcatggtcttgataaaatgctttaatgttgtcggcgcctttgccggaaaactcactgtcatctaaatcagctacagctttaaaagccttttttagattgaccatctgacttcttaattctttgtattcctttgcacgtctatctgcttctgaaagcagtgatttggcttcaaatactttcatgatcatatcctttcgtttgaatagctccaacaagattttaccatgggaaaatgaagaaatagacagcgatataattcaaaagtgtggaatgaataatttgatctgtgtcaatttacctattcggattatttgtttggaaactaatgacgcagtaagacgattccagttgatgaatggtttaaatcctaatggcatttatggcccgaaaactaaagcgaagctcgaatcccttcttaaataaaaaagcccttccgattgggagggctttttctcttatttaatagatacgtgatgtgtataccagtttccggttgcagtgaatcgtaattccatatggccgtggcggttacctccatactttacaaacgtgtaatcagaattggcgattgcatccttagccgttttgtcaatgtttgcaatttttttggaagtaattttaccattccagccagcaaaacctgaagcggatgcacttggcggactttcccactttgttattttctttccatattcgtatgaatagttgtcacttactcgaatatcatataattttatccctgtaaactttacagcgtaatatccacttgcagttttattttgggtggcctgtgttgttatcttttccaatcccatatctgtactgacgcccatttccacagtgaaaccattaccgagatcaatttcttgatatggatgatctttgctgacatgcatactgtttaaagccttattcacttctttaacagttgggattttctcagatgaaagggttctcaagtttttttgttttgttacctcgtaaaaggtcgccttatcaataatcagatcagaattcttgtccactttttcggcagcatttgcgctttggagactaaacagagatgaaaaactcaaagctagggcaaaaaccacacccacaagtaactttttcattttatccctccttaatgttttcgtccccatcttatcccggtgtataatattggtaaaagagacaaaagtaacaaatgatgctattgattaaagtattaggcttggaaggaaagggaagatcgaaaagtaaatgaatggttttacccatttaaacaaccatatatcaggtgtatattggattgtaggggagggatatcatggtcaagattatattggcatttgtttatctatttggcttcgttgtgttgagcaattgggctttcgacggaatattttcagagagctatttctcgccgatcggtttcctttggtctattttatttacatttttcacaggggtttataccggcttgcctttaatctacaaaaagtttactcaatcaagccgtttgactttgaaaagtaaaaagccaatttatttcactatcggtacagctgttattctctttgggctttattttctcaaaaacgaaatcgccccctattttatgctatgtggctattttttaactctggcatcaggtatagccctgaccatcttattacagcccaaaaccaacaactgtaaaacagtataaccaacaagaattaattaaaagcccgtcgttttttaggcgggctttatacaaatttaatcaaaaaggaatatttttaatcagaaacttatgtaagaaaaccctataaaatagggtttgggaataaaacgtctgttcgtgtcagaacataatctctaccttgtgacagggtagagatccctggttcgagcccagtcggaatcatagcttaaacccttgctgcgcaagggttttttactttttataggggctgtcggtttattaatgcagtatatgatttaaatgaaaactcaggaataatattgagttgagaagataaaataaaaaccccatttctaaagtccaaaatggggttatttcttaatatcatattaagttgctgctctatctgcgaccttataagtggactgctcagaaagagcgtatgaagcgctggatactccaacaatgccaagcaagagcgctaaacaaattgcaattttacattttttcatttaaatgtttccccctttgaatttgtttacgtgcttcaattgccatttgataaaaatcgaccgcatcatgtctgtcttctttgttggtcaaaaaatcagcaacagcaacagcgtattcttccatatcaccataaaggtttttctctttgaagaacttgaacacttctctaagtgtttgtaagtcaaatgataaataaagacctttaaccagttttaatttctcggttacttcctggttgttgtgtcgggcagcaaccttctgaccttcctggtataattctaacgcagcctttaaatcattcttctttgctttgacatacgccagattaaaaatcgctttggactcataaatgtgctttcgattcttatgaatttcataggcgatttgaaaatgtttctcagcattgtcaagttcttcaagattattataacataatcccacattaaaatgagctgaaccaattaaatgttgttcccctatttttatagcatcatttaaggctttttcagctgtttctaaagcgtcctcataacacattttatctagccagttcccaaagataacaaactgacattgaaccatttccttgccatatgtaaggttcccctgagcatctttttgctctttaaatatagagtatgctcgctgggcataattcattgaaaaatgagtctctttcatatagtaatagacttctgacattttgaaatagaactctgccttatctgtatttgcgttcttatctaataaatcaagatatttttcggcttcgcgataatatgttaaagcaataactaaatctctcgttctaaaatgatacatgccggtaaaaaaatgataaaagaactctattgtattggtgagggatgcactcgaagtcgtctaatgatttataaatggcatctatctttttcaagaaaatgttataatgaaaagccataaaatgataggagggggaatttcgatgcattacataacggcatgtttaaaaatcatcagtgataaagaccttaatgagataatgaaggaattcaaaaaacttgaggaagaaacgaacaaagaagaggggtgtattacattccatgcttatccgcttgagccatcagaacgtaaaataatgctttgggagatttgggaaaacgaagaagctgtgaaaacccatttcacgaaaaaacacacaatagacgttcaaaaacaagaattaacggaagtagaatggttaatgaaaagcaatgtgaatgattgaaaggctctttaaaaaaaagacattcaatgacttagaatcagccacttgtgattaagtagtaaattgttgtccaactcttatttttttctatttaatattttttgagacgaaaatgtttttttgagctgattttgaaatgtattcaaagtcagctctgtttgatttaaaggattatattctttggataacttgttaccatcataatggagatactccgtataaattggaggttaaaataatgagtcattctcaagaaaaaattgcactaattacaggagcaagcagtcaaggggatattggtacggctatttgtcgtaagttagcctcacagggtatacatatcttctttactcactggaattctgatacggcctggatagaagaatttcaacaagaaattttacgtatgggtgtccgctgtgaggcaatgaaaattgatttatcagatgcacatgctgcattcacaatacatgaaaaaatttcagataaattaggatatccttccatccttattaataatgcagctcattccgcaagtgataattatgtatcgttagatgctaaatcacttgatgagcattatgcggttaatatgagatcgaattttcttctttgtgttgaattcgcccgtcggtttaaaaaatctaatttaatatcaggaagaatcatcaatatgacatcagggcaggatttaggtcctttgcctggggagttagcgtatgcagctactaaaggagctatttctgcctttactaggtcgttatcacaagaacttgcaccattgggcatcactgttaacgccgtaaacccaggtccaacagattctacatggatgacagatgaaataagaaattttctttcacctaaatttccaatggggcgtattggcacaccagatgatgcagcacgaatgattgcttttcttgcaagtgatgaggctgaatggataactggacaaattattcattcagaaggtggatttattcggggctaagctactgaaacacaatatacaccaatgtatgatgtattcccaaaactaaatctaaacttgaagcgcaattgaaataaaataaggtcccttctctttttagaggggaccttattttattcatgcatgttttgcatccagaaaatctggcggataagagattaataaaccgttacatatacttttccgaatactgcagtacctttaaacaaagtaatcgtggctttcccttttgatttagccgtcactaaaccattttgatcgacttcagcaactttttggttatcagtccaataacgagtagctgaattatttttaacagaataggtttctccaacttttagaggtaaattatagtcttgaatcttgataacatgtgtaggtgaaatagaaatgttctttacttcagtaggtgtggagtttatttcatgagctgaagctaccccgctgaccgacagagctaacgcagaaatcgataaagcagaaacaacagtttttttgaaattcattttgaaacactcctttaaagttttttgtcttgcactataacaattcaataaaagtaattattttccttgtaaataaatgttaataatatgtgaacgatcaattgatttgagctaagaatattgtgtgcgctgcacagagtttgtatttatgattgaaaattgctgagagagaatggccatccttaaaatgttaatagcacacatttgaagggtattagtttgttgagcgtgtgggaattttgttacctgcactttatccccgaagataccaaatcatttttcttcatcatgttcttactttcgtactcatacattagaaaatcttcgttctaaataggtgaagaattggagtatttttatgaatttctgctgaatatacattacatagcaaactcaaagagtataaaaatcgcttttttccggaagcttcggtaaaaaacaaaacttttgtctctatgattttattttataatgtaaacggtttcttatatattatacttatactatcaatttgctcaagtagatactgacaggaaggatagaaaaacagatggaatacataaatacaagacaaaaagagattttgtatctgttgttatctgaacctgatgactatttagttgtgcaagatttcgcagatagggtacagtgttctgaaaaaacaatccggaatgatttgaaagtgatcgaggattatctcaatgagcattctcatgcacagcttattcgaaaaccagggttgggcgtttatttacatatagaagaacaggagaggacctggctaagccaacaattacatactgatcatttttcttctaggcagcggaccgatgaagaaagaatgctgcacattgcttatgatttattaatgaatccgaagcctgtttccgcaaaagaaattgccgctcggcattttgtcaatcgatcttccattaaaaaggatttatacgcagtagaagagtggctgaagcgttttgatctcacgctcgtttctaggcagcggcttggattaaaggttgaagggaacgaaagaaataaaagaaaggcattggcaagaatatctgatttgattcacaatacagagtttacgagccaatttattaaaagtaagtttttacattatgaagtagattttgtgacgagagaaatcaaatcattacaaaaaaagcattctctctatttcacagatgaatcgtttgagagtttgctgctgcatacattattaatggtccgccggatcaaaatgaagcagccgatctcgttgtccccgaaagaaatggcggcagtaaaaaagaagaaagaatatcaatggacatttgcttgtttgcaacggctcgaaccggtttttgcaatccgttttccagaagaagaagccgtgtatttaacattacatatattgggcggtaaagttcgttatccattacagaaagaagaaaactttgaaaatgctgtgcttcctaaggttgtagagcatttaatcaatcgtgtttcagagctgaaaatgatggattttcataaagacctggatttgatcaatggtttgaacattcatctcaatacagtgttacagcggctgagctacgatctttcagtatcaaatcctatgctgaatgatattaaaaagatgtatccttatttgtttcatcttatcattgacgttttggaagacatcaatcaaacatttgatcttcatattcctgaggaagaggcagcatatttgacactgcattttcaagcagccatcgaacggatgcagtgcagcagcgaggcacataaaaaggcgatcgtcgtctgccacatgggaattgggatgtcccaattgctgcggacgaaaattgaacggaaatatcaccaaatcgctgtaatggcttgtattgcaaaggccgatttaaaggattatatcaaaaagcatgaggatatcgatcttgtcatatccaccattgcgctggagaatataacggccccccatattgttgtgtctccgctgttagagcctggcgaagagaagaaattaagtgcatttatacgtcagctgggcgaaccacaccgccaaaaacaaaaaacgtttcagatgctgaacaatacgactccttttttggtttttttgcagcaggaggcggagcatcgctacaagttaattgaacagctggcgacagctttgtttgagaaaggctatgttgaaaaggactatgcggttcatgcggtgatgagggaaaaaatgtcggcgacaaatattgggtcaggcattgccattcctcatgcgaacgctaaatttattaaacaatcagcaatcgcgattgccacattaaaggagccgcttgaatggggaaatgaaaaagtttcgcttgtctttatgctggctgtcaaacacgaggatcaaaccatgacaaagcagctgtttagcgagctctcatatcttagcgagcagccggcctttgtccaaaagctgacgaaagaaaccaatgtcatgtcatttttatctcatttggattattaaaaagcagggattattccttgcttttttttgttatagggaaaaatgcctttatttccggaacctatggtaaaaaaagcgatttttaagtgctgatttcggtatacagttgagacaagatctgattattcacactttaaaggaggtttcctatgaaactgttagcgattacttcttgtccgaacggaatcgcccatacgtatatggcagcggaaaatctgcaaaaagctgctgacagaatgggcgtcagcatcaaagttgagacccaggggggaattggtgtcgaaaataagctaaccgaagaggaaattcgcgaagcggacgcaatcattattgctgcagaccgctcggtaaacaaagaccggtttataggcaaaaaactgctatctgtcggggtacaggacggcatccgcaaaccggaagaattgattcaaaccgctcttaacggggatatgccggtctatcgttccgctgcaaaatcggaatctggcaatcaccaggagaagaagcaaaatcctatttaccgtcatttaatgaacggcgtttcatttatggttcctttcattgtcgtcggtggattattgatagcggttgcattaacgcttggaggggagaaaacacctaaaggcttagttattccggatgactccttctggaaaacgattgaacagatcggcagtgcttcattttcatttatgattccgattttagccggctatatcgcctatagcatcgctgataaaccggggcttgtgccagggatgatcggcggttatattgcggcgactggaagtttttatgacagcgcaagcggcgccggattcctcgggggattattgccgggtttttggccggatatgctgcactttggataaaaaaattaaaagttccaaaagcaatccagccaattatgccgattattattattccggtgtttgcatcactgattgtaggtttagcgtttgtgtttttgatcggcgcgcctgtagctcaaattttcgcctctttaacagtttggctggcggggatgaaaggctcgagctcgatccttctggcattgattttaggtgcgatgatctcatttgatatgggcggtcccgtaaataaggtcgcatttctgtttggatcggcaatgattggagaaggaaattatgaaattatgggaccaattgctgtcgccatttgtatcccgccgattggccttggtgttgcaacgtttttaggaaaaagaaaattcgagacatcccaaagagaaatggggaaagcggcatttacgatgggactcttcggtattactgaaggagcgattccatttgcggcgcaggaccctctgcgcgtcattccaagtattatggcaggctcaatgacaggttctgtgatagccatgattggcaatgtgggagacagagtggcgcacggcggacctatcgttgcagtgcttggcgcagttgatcatgtcttgatgttttttattgctgtgattgcaggatctcttgtcactgctctgttcgtcaatgtactaaaaaaggatattacggcgtctcctgtgctcagtgaaactgcaccgccctccgcgccaagtgaagctgcggcagcaaatgaaataaagcagccaatccaaagccaaaaagctgagatgtcggaatttaaaaaactgacagacattatcagcccggaattaattgaaccaaatttatcgggggaaacgagggatgacatcatagatgaattgattcagaaattgtcccgaagaggtgcgctgctttcagagagcgggtttaaacaagccattttgaatcgtgaacaacagggaacaacggcgattggcatgaatatcgcgattccgcacggaaagtctgaggcggtcagggagccgagtgttgcctttgggatcaaacgatcaggcgttgattggaatagcctggatggatcagaagctaaattaatctttatgattgctgtaccgaaagagagcgggggaaaccagcatctcaaaatactgcagatgctatctcgaaagctaatggatgacaattatagggagcggctgctctccgtgcaaacaacagaagaagcctacaagctgctagaagaaatcgaataaagcgggggattttcatgacgactgaaccgttatttttcaagcctgttttcaaagaaagaatttggggcgggaccgctttagctgattttggctataccattccatcacaacgaacaggagagtgctgggcttttgccgcgcatcaaaatggtcaaagcgttgttcaaaacggaatgtataaggggttcacgctcagcgaattatgggaacatcacagacatttattcggacagcttgaaggggaccgtttccctctgcttacaaaaatattagatgctgaccaggacttatctgttcaggtgcatccgaatgatgaatatgccaacatacatgaaaacggtgagcttggaaaaacagaatgctggtacattattgattgccaaaaagatgccgagattatttatggccacaatgcaacaacaaaggaagaactaactaccatgatagagcgtggagaatgggatgagctcttgcgccgtgtaaaggtaaagccgggggattttttctatgtgccaagcggtactgttcatgcgattggaaaaggaattcttgctttggagacgcagcagaattcagacacaacctacagattatatgattatgaccgaaaagatgcagaaggcaagctacgcgagcttcatctgaaaaagagtatcgaagtgatagaggtcccgtctattccagagcggcaaacagttcaccatgaacaaattgaggatttgcttacaacgacattagttgaatgcgcttacttttcggtggggaaatggaacttatcaggatcagcaagcttaaagcagcaaaaaccattccttcttatcagtgtgattgaaggggagggccgtatgatctctggtgagtatgtctatcccttcaaaaaaggagatcatatgtttctgcctcacggtcttggagaatttaaactcaaaggatatgcagaatgtatcgtctcccatctgtaacatggcagggcttgagaaataaatttgcgagtgaagacgcctattctccagcaatgatctaactaaaataagagtttaatagttggagaagaaatgttacactcttttctgtatatggtaaagaatgaaaaaacacgattcggttggtagtccggatgcatgattgatcatgtcagtaaccttcccctcctcgggatgtccatcattctttaatatcttttatgaggagggaatcgttatgaaattaacggtttactatgatggtcagttttgggtaggcgttgttgaagttgtgaacaatggaaagctaagagcctttcgtcatctttttggcacagagccgagggattctgaagtattagagtttgttcataaccaactcctgaatatgttggcccaagctgagcaggaaggagtttgtttacaaggcagacgtcaaaaaaagatcaatccaaaaagattgcagcgccaggtttcaaaagagttgaaaaacgccggagtagcttctaaagctcaagaggcgataaagctagagcttgaagcaagaaagcaagagaaaaaacaaataatgaaagaacaacgagaacatgtaaaagagcaaaggtatatgctcaaaaagcaaaaagcgaaaaagaagcacagaggtaaataatccaaacaaaagcaggcgcagtgcctgcttttgtaattaaggactctacttcgtaacatatatccaatgtttataatccgctgatttatgatccaatataaaccctaacttctccaaggttttttgtgagcctagattatcatgttcacatcttgcggtgatccgggatactgtttcttggcttaatgcccagtttattagtttttgggcggcttccacacaataacctttgcggcgatgacttttatttgttgcaaaaccgatttcaatcatgccattttcgtctgggtcacctaaaaatccagttcccccaacaatttcatgactgtccttctttacaataatccatgaatcaaatccttttgttccattgtttttgactaaaatctcgcggaaataaggtatcgcttcaaaaaaatcagaatttggccattcaccatttgtttcataacctaagtctttgatagcctgatgatcttgtttagacgcggcgtcaagaaggggaatatcaatcgtttttaaacgtaatcgattcgtttcaaggagaaccatatatctaatcctcttttctttttactgggaataatgataacatataacaattttctctgataccttggcagtagagaaagatgaaaaaattgaggggattgaaagagtgacaggtgagagtttgcccagcccaaaaacgggtaggaaaatgctgatgttaatgtgtccctacccgtttttctgttcctgaatgcagggtttctgataacatgttgtgctaccttttcgcaatcaaataaagcgatatggctctttgggtttgcacaggattatgaatgataatgacccattggtttcttcgtcttggaaagcttgctaccgcatacaatggagcagtatcgcgcggagtgaacccaccatttatcacgttgatatctcttccttctagatgacaaactaagtattcacctggattgatgacctgttggttcgtccatgcgtaagaataaaagccgtctctaagatcttcggtggaagatgggggacaaagccatccacagtcaatgtgatttctcttcttcgctgtctttctgaaaagtctggacttctttgagggttatgagtatgtgaaaagtaaggaattaacgcagggccataaaagtaatgatacaaagcaaccactcctttattttccattcatacaaattgtatgtgggagttatttgttcattcctgttttgttccatgtagactaataatgggctataggtgtccaaggtaatcaatttgtcctttcgttgttcaatgctagtaaccttgaaaatgcaggttaggatgatagaatttacatattactgcaagaagttagacatacatcattttgatagtgggtgaaaacgatggcgaaaaaaatggcaaaaacaaatgcggttcgtctgatagaacagcagaacatctcttatgagttattagggtataaaacagacggccagcctgtagatggcatctctgtttcggaaaaaatcggttatcctgtgaaatatgtatataaaacgttggttgcagcagcaggaacaaatcattattatgtctttgttgtacccgttgcagaagagttagatgtaaaaaaggcagcaaaggtgacaggggaaaagaaaatagaaatgattgcaatgaaggagctattagcggtaacaggctatcttcgcggcggctgctcgccaattggcatgaaaaaattgttcccgacctatattgatgcatctgcagaaacgcttgattttatcattgtcagtgcagggaaaatcggtatgcagctaaagttggcgccacaagatttagccaaatcatgtgatgccgcatttgcaaaaattgtatagatgcagatataggggaaacgaaaaagcttagtcatatcgattaagctttttccgtatctctttcaaatatgatttcaaaataagcagctgccccatacccatctatactgggagcgaaaatctgaacgaatctccagcctcttttcgcataatcatggatgatttgctggtagtcttctttaggccttcttctcatcgtgctcagctcaactcttacgaattcatattctttcattgtttgatccctcctattaaggtatacgcataattgagcaagaagttccgaaaacctaggttaaggtccgaaagtatatttcgctcactaaacaaatacatttatgccagatgcctgcatgcatctgggaagagttaaggggctataaaaacgaattttaccgggtcagcagttcaaataaatctcttgcttattgcatttgactgagtatataagtaaaaaaagagcggccagaacatataagaaggagatgatcattaacgcactcataacagggtagtgtttagcggagtagatgaaaaaatcaagctgtgaaatttgtttggggctgctgacggcatcaattccatttagcagttttgagagtttagcagtatagttccaatcaaatcgatctgaaacaagctcgcttccttgataccaattaacagcagctaaaaacagaaatatcataatagaaaatccaagctgaacaactaaaaatattcccttcacttttatatgacctccaaatctatgaatatgggaaaatcaaacaatatattaccaccgtatgggttattcttgcaatttcactttcatacaactcaaacgcaagtctatttttttgtttgtttttggcttataatacctgatgatggaaaaagaatgcgggtttatagattagagaaacaaatgtatttcttagcattttttatttgtggagagagtatagaagcattcgattagatctgctttttcacagaaacggttttcatctgtttgcctgagctttacaattggctggcagaaaaacaatgatttctttcaatcaaaacatgcaacgatgcgacacattttatatcttgatgacttatctcattgcctttaagtcatcctatcgagaaagcgatggtattttatgaacaaagaaaccctaaaaaacatactcatgattttttcaatatgcgcaaccctccgagaaaccgatggtatgcgcatagctgatagctggattttgagtgagattatacgatttttgatttgcatggctgtgttttttgccgtgacatttctattagatgctgtttttccaaacaaaaaagagtcacattaatgtgtggctctttttgcatcatctgatcagaaacatcataaatgaatcgatcatcatgatgaagaacagcaagcaaaaataaataagcgagtagacaaacatatcctttgcccacttcacgtcatcgtctgttttgaatcccttgatgctttttttgatccatatgcctccgagaaccaaggcggctaagaaataaaatgggcttatatggccggtgccgagagagaaagggaataatagcgtgaccggcaccaggacggcaatatattgcatcatttttatttttgttacatggttgcctttgactactggcaagagcggaacgccagcggcacgatattcttctttgcgtcttatcccaatcgcccaaaaatgcggcggctgccacagaaacataatcgtgtacaacagcactgctgtcatactgaagtcaccggttacggcacaataccccatcaatggcggcgcagctcctgggaagctcccgacaaatgtgctccacacagacgttcgtttcacccataccgtatagatgatcgcataaaaaataaaggcggccagtccgagaaaggccgttaatggattgagggaataaagcatggcaagacctgtgattcctaaaacagatccatatgttaagatcatggctggcggcattttccctgtgaccgaggccctgctgcgagtgcgtgccatttttgcgtccatatgccgatcaaaatagttgttatagacagtgccggaagccatcacaaacgcggttcccaacattgctgtcaccattgtcatcaaaaaagccattccggttaacgttttttctgcgcttgcaaacgcgatccaaaacccgccgaaggctgctatcgagtttgatatgataatgccgggttttgcaagtttgataaaatcgtaaatggttacccggttcgaagcttttatgtattttgtttcagatatggctgcagaatcccttgtattctccaaaaatagacgcctcccccaaaactgcatgcttttgttatcgtaacaagagggagacggaatcacaattatttcctatatttgtcatgatattgtcatttttaaaataaaaaaatggggagctggactgcccccattttgatatgcggcgactagtaaccgtaacctccgccatatcctccgccataaccgccgccgtaaccgtaccaagggtagtaaggcggtctcgggcgcgggtagtaataaggcgggcgcggataaaacgggtagaacggataatacggtcttggataataaggcggataaaatggcggtctcggacgcggataataataaggctgtctttcatcataaggggtaatttgttcaaatggctgttcattcaaagggtaatccaagaggaaaacctccctagctttttttattccttttactatattcttgatgcttaagttgggtgtatgtacattcatgaaactcggttttttttatgatgaaattccttaaaaaggattgacatgaacttctaaatctcatagtattacaaatgtgaaataaatgttactacaatgttacaaaatcatttctaaatagatacagttccaactgatgaagagtaaatcgaaatggctacgaaagaaggagtttttgttgttggcaaaaagaatcaaatggtttcatgtattaatagcagttgtatgtgtggtgggccttatcggctttttccataatcattcattgaaaaaagaaacggtcatgaataaagtaagaactgattctcaatatgggaatgttgagatcgcaacgcttgtgaatgacgggaaaacttttaattacgcggttaactatcccgttttcaaaaatgaaaaaatggattcggcattaaaaagattcgcagaaaaagaggttcgtcaatttcaaaaggaaacaaaagacgttgaccaagagcatacgacaaaacgcaacgaattaaatgttgattataaaattgtccattatgccaaacagacagtggcgattgtatttaatgaatataaatacatcggcggggcacacgggcaaaccgtgaaaaaaacgtttaactatgattttagtaaacaagcgtttctttccattgatgatattttcaaagaggacgctgactacttacataagctttcgttaatcgcttatcacgaactgaaaaagaataaggacattgcagcggacgatgcactgttaaaggaagggacggctccgaaaaaagaaaatttcagccgctttgccatcaaggaggattatatcgaactttactttgacacatatcaggttgcagcaggctatcttggagagcaatcgattgccattaagaaaagtcttttgaaagacattctgaaagaacaatatattgataaagcaaaaaataaaaataaaatcaaagaacaaaagccgaagcatgaagtgatttctttacccaaagaggaaacggttgatccaaatcaaaaagtcattgcgcttactttcgacgacggcccgaatcctgcgacaacaaatcagattctagactccttgaagaaatataagggtcatgccacgttttttgttttgggagcagggttcaatattatccggaaacgctaataagaatgctgaaagaaggaaatgaggtggggaaccattcatggagccatccgcttctcacaaggctttcagtgaaagaagcgttaaagcagatcaatgatacgcaagacatcattgaaaaaataagcggataccgtccgacgcttgtaagacccccatacggcggcattaatgatgaactgcggagtcaaatgaaaatggatgttgcgttatgggatgttgacccggaagattggaaagaccgtaacaaaaaaacaattgttgaccgtgtcatgaatcaggcgggagatggaagaaccattttgattcacgatatttaccgcacctctgctgatgcggccgatgaaattatgaaaaagctcaccgatcaaggctatcaattggtgacagtttctcagcttgaagaggttaaaaaacaaagagaagcgaaataaattaaaaaaggctgtccgtacggacagccttttttctatttaataagagcctgtggtggcccaaacatttaagtttggccctgaatacttgccgaaagcgtaagaagtccttggatctaaatcatataccatcggtgtatagcaagacttttggccggccaccgcttttccattgccgcctgcagaatcacaattatatctcttgccgtccgtgtttcgggtaatctccgcatttgcttcaaagccagacgtcaatgtattattcatcgtgatttttgcccaagccgttttacatgtactgctgaatttaagctcgactactccgatgacttgattgcttgcattcactaagtttgaggatttttttgtagagccgctggacgcacaatcattgtaataagggctttttccatcgtaggcatgggtttccgcattggcgggtacacctttgacggcaaaaacaaatactactgcgaataacaccaatgaagccttcgtaaacagtcttttcatatcctttatgacctccttaatatggcaaacaataaatcatacggaggaacaatcaaaacatgcatgcttttttgtgaacaataaaggcggccgggaggatggagttattggccgcctttggtgtgaggttaagcttttacatcaatggtttgtccgagagtcggatgctgaatcatctttaaggtttgatcggcattttgctgggcggtgtccagcatttttttcgttaaagcgatattaacattctgggcaagggatgcttgatgcattgcaactgataaagcaggaatatccatcgttccacctcctatgtcttacctatcggcggctttgtatcattttacagtgaaaaatggcttaatttctcctgttgacccttacgctagagcataccgtatgtttttgacaaggagggatcaggatgaatcttgtaatggaaaagacctttgagcaatacgaaaagctgttttcaatggaagaacagaaaagagaagatgaatttcggtatacgatgatgaggccgtttgaaaagatgtggaccgccatccaagttccgctgaaagcgaaggagccaaacggctatgatgtgatcatggctgcgaaaatgctgggctatttggatgtccgtgatgctgaaagcgggcagaaagcactgcaaatactgaaagaatcacatgtttcagagacagctgagtctgcacttcggcaatgcatattttttgctgagcgcgaacagctgcgggtgaatgcagaggagatcaaattcggcctttatatcgctgatccaaataaacttcagctgcaaaaaggctactgcgggtttggcgggataccgggctttattcatgtatggattgatccgaaccgttataacctgccaaggattccttcaattattgctcatgagtttcatcataatgtgcggttttcgtatatagattttcatcatggctctgtaagtgtcggggattatcttgtgattgaaggattggcggaatcattcgccagagagctgtttggcacggaacgattgggcccttgggtaactcgttttgatcatgaggatttgcaatattccattgatgtgattaatgaggtgctggatgtgaaaggattttcggaagtcagccgttatatgtttggtgatccaattgctaacgaccaaggctttaagcctgcaggtttatcggcttttgcgggttatgcagttggctatcatgccgttcagtcatttatgaatcaacatcatatcacgataagcgaggccacgcgtttggatgcgaagaccattctttctcagtgcggattgttttccaaatgaaaaaaagcgtcacatacagcggcgctttttgattcccaaaaccagcagttctatggcggcacaggcggcaattccgattgtatatgcttcgatatcgctccataaaaaaccgtaccccagtacaagtccgccaagagaagtatccctaatctgatcgatccattcggcatgatagagctggctgaattcaatgacaaaacagaaagaaagactgataatgcccgttatcattgtcttcagcttccgaaatagaaatccgcatcccgtaaagatcatggcggcccacaacgagtccccaagataagtattgagggtatcaggaagaaccctggagtatgctctggatccaagccccagcccaatgatcagtaaggtgaaaactgcatatatccaacgatttcgcttcattgcgaattgataccccgtctctgcttcatctccctgtattgtaaggaatatagcttttatttgtccactaaaaaagcggctgaatagccgcatagggtgtttattttgcttttaggtttacatggtcggctgtctgatccgtgcctattacaaaatggagttcatagcggcctgtatcatatacataatcgatttcatcggtaaacgggacggttaacacccgatttgctggccctaattgcttctgcagcacttccggcgtaactccgcctaaattcagctgccgttccacaccggttccaaagtagcggatttctgaaattgtcatgtctttatgataggaaaatccgtagcccggctgtcccatattccagtgatataaatcaaatcgattgtctcccccgactggtctttccggttccccaaacgcagcgtggacatccccttttgtgcttttgttaatggtaaggccttgcgcctgctgaggcatttcccctttgtaggcggtgttgtaaaggtttttgacgagctcagtggctgattggtttgtattttcatagagtgtatttgtttgagctgcggcctttgccggtgctgaaaaggacgcagccccaaagccggtaaaacagcttgttactgctgccgcagcggtaatagcagacattgtctttttcatgttgatccctccttattgatctaccatcccgtttcccggtgttagtgcaataaaacatgtgagtgcgctttgtatgttttattgagttgttgtaagggaactgaaataggtaattcggtatataaagcaagaaaggggaatggagatgcctggcaagaaaaaaatcacaataaacggcgttgaaatggaagcgtccgaggaacagacggtgctgcagcttttgaataacagctcgattgaagtgccgcaagtttgctatcatccaagcttagggccgattgaaacatgtgatacgtgcatcgtcagcatcaatggtgagctgaagaggtcgtgctccgctgaattaaaggatggggatatcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtatattgtgcggacgctgtgttgaagcatgccaggacgttcaggtaactgaaacgctgaccattgactgggagcggaaacgcccgcgcgtcatttgggataacgacgtgccgatcaatgagtcgtcatgtgtgtcatgcggccattgttcaacggtctgtccgtgcaacgcgatgatggaaaaaggaatggaaggggaagccggatatttaacaggcatcaataacgaaacgctgcgaccgatgatcgagatcacgaaaggcgtagagacaggctacggctcgattctcgcgatttctgatatggaatctgctatgttcgatgaacgaatcaaaaaaacgaaaaccgtctgcacgtattgcggcgtcggctgcagctttgatgtctggacaaagggcagagacattctgaaagtagagccacaggaggaagcgccagccaacggcatttctacttgtgtgaaaggcaagttcggctgggatttcgttaacagcgaagaacgcctgacaaagccgctgatccgtgaaggtgaccatttccgtgaagcagagtgggaggaggcgttatcgctgatcgccagcaagttcacggaattaaaagaggcgtttggcccggattctctcgcttttattacatcttctaaatgtacaaatgaagaatcctatcttatgcaaaagctggccagaggggtcattggcacaaataatgtggacaactgctctcgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcgcattaaacgggctcataagctaagagggcagaaagtgatcgtcgccgatatcagaaaacacgaaatggcagaacgctccgatttatttgtccagccgcgtgccggatcggatatcgtctggctgaatgcgatcgccaaatatttaatagaaaacggcaaggccgatgaacgatttttgagagaaagagtgaacggacgaaatgaatatgtaaaaagcctcgcgccgtacacacttgaatatgctgaggagaaaaccgggattgatcgagaaacccttatccaaatggcagagatgatcgggcaagctgacagtgtgtgcgcattgtgggcgatgggcgtgacacagcacattggaggaagcgacacgagcacggcgatctctaatctgctgcttgtgacaggaaactacggaaaaccgggagcaggttcttacccattgcgcggccataataacgtgcagggagcaagtgacttcggaagcatgcctgacagaatgccgggctatgaaaaagtgacggacgaacaagtccgccaaaaatacgagcgggcgtggggcgtgccgctgccgaaggagccgggtatgaccaaccacgaaatgattgaaaaaatccattccggacagctgaaagcgatgtatgtaaaaggtgaagaaatgggcctggtggattccaacatcaatcatgtacacaccgcatatgaaaagcttgatttctttgtggtgcaggacattttcctttcacgtacagcggagtttgctgatgtggttcttcctgcgagcccaagccttgaaaaagaaggaacctttacaaacacagaacgccggattcaacgtttgtatcaggtgtttgaaccgctgggcgaatcaaagccggattggcagattattatggaggttgccaataagcttggcgccggctggcactatgagcatcctgcagacattatggagaaagcagccaagctgtcgccgttttatgccggtgtcacctatgaacgtcttgagggctataattccctgcaatggcctgtaaacgctgatggaaaggattcgcctttactctttacagagcgcttccctttcccggacggcaaggccattctctaccctgtccagtggacagagcctaaggaattcggtgaggaatatgatatccatgtcaacaatgggcggctcttggagcacttccacgaagggaacctgacttacaaatcaaaagggatttcggagaaaacaccggaagtgttcttagaaatttctcctgagcttgcggcagaacgagggattcagggcggaaccctcgtcagactcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcagccgcaaatcggtgtgcaggttcaaaagaaatgggcgcggaaggattatattttccctggtgacgccgtgaaaagggggatgggccataatggctaaagcgattaaacaaatccagaaaatcgaggtaaccgaggaggatcagcgaaagcgtgatttacgggaaattgaagatgctctagttgatcacaaagaagcgattctcgaaaccttgcatatgctgggccatatgaacgagcgcggtgtcctgccgttgctccgcggcctttttggccaaggggataaagttcttgatatcctggtgaaaaaggcagatacagaggaaacagccaatacgctgaaaaatctgcttcttctgtttggaacactcggcatgctggacgtgaaggagctggagcctctcattttgaaagtgaatgcgggtgtggcaagcgctgtagagcagaaaaacagcgaagaaaagacaggttattttgatattatccgctcgctaaaagacccggaaatcaataaatcaattacactgctcttttcctttttaaaaggaatgggacaagatacaaaggagctggaacgcacgacgcagcctccggaacaccaaaaacatcatcaggaacccgagagaaaagaggaatgaacaagcgagattgacctcccacccgagccggcttcagccagctcgggtttttttatgaggtgagtcttaggaactaggatgaaatatctaattcagaaacaagacaaagtagctttgattttggaaaaatgaaatgacagcataggcccgtccagtattttttcagtagaggatagatatctatatcattggctgacctataatatgactggaaatgatagagtaatttgttactttgttctctgttaagaaaaggaaaagcgtgattataatagaaaacgattactttagatggaggaacagcaatgaaaaaagcattattcattttgtttgtgctagcgattggctttgcgctttctgcgtgcagcaagtcaagtgatgcgtcagctgagcaaaagacagcaaagaaagaagcaacagcaacggaaaagaaaacagaggaaaaaaacgaaaccaaaacggacgaaaaggtgcataaagtaggcgaaacttttaaagcttccagcacaaatttctcggtcaataaagtatatacgacggcagaacaaggtgaatataaggcgaaaataggagataaagaaaaaacaataaatcaaaaggaagaatttttaatagctgaggtatcgatcgaaaatacaagtgacaagcctttcaattatacgagtggcggttttgaattgaaagacagcaaggatgaatcgatcagagcaaacatagtatctactgctgacctgaaaacaagcctaaaatcagggaagttagcctcgggtaaaaaggtatcaggcacagtcagttttgtgattccaaaaggagaaaaaaaccttactctatcatataatccatcatttttaaattttgaaacagaggatattacatatttggtaaaattgaattaaggtatcttttgagcatgtcaccggaagatcggaacatgctttttttatttcaaagagacttatggtataaaatggtagtgaggtgatcgattatgcaaaccaaatggctggaacgggcacagcggattcgggcgatcgcccaggcggggcttgctttttccaaggatgtgtacgacagggagaggtacgaagagctaatgaagcttagcgcggaaatgatggcggattactcacagacggacattgaagttatcactgatttatggaaaagggagagcggctatccgacaccgaaagcggatgttcgcggcgcagtattccgagagaatcagattttgcttgtccgggagaagcatgatgagctgtggtcgctgccgggtggattttgcgagattggtttatcgccagctgaaaacgtcgtcaaggaaatcaaagaagagtcggggtacgatacagagccgtctcgattgctggccgtgctagacagccataaacactctcatcccctcagccttatcactattataaaatcttcatcgcatgcagcatgacgggcgggcagggggaaacagggatcgagacgaatcatgccgctttttttccggaagacagactcccgccgctttctcctaaacgaaacaccccctcacagcttagcatgctgtttgactttttgcgccatccggacaagaaaacgatatttgactaaaaaataaagagcctatgggctctttattttttataatgtaatgtgtttttcgttggcgagtttcagaagggtcaaaatagaatcggcttgtttatggccgagtttttgctttaatttgttttcttcaactaatcggctgccataaattttgacagaggctttgtcgacgacagtatgccagttttcctgtttttttccctcaacaagcggtttttcatgtctctcagaaaaagagaatacaaacagtacgaatgcaagtgaaagtaggatgccgacaacttgttttttgtaatcagtctgtgctgccacgttgttctctccttcaccttttaccttctatttaatcatagaatcagcttattttacataatgggaaagtcatttttggagttagtgcatttggttgaaaacagaggcgttttttgagcggagcggtgcaattgaatccatattggatttgcgtgcttatgcctaaggtcacgttgtgagccaaaacagcagtgcagaatagaaaaaaattgaaagattatggtaagatgaacgaaattcgaggggaatatatgatgcctgcatcgaacatcgtgatagcctgcctgctgttatcaatttgcttatatgtggtagtccctctctttttcgaaagcgggaggtgaagtggaacattcattgctgaattctttcaagggagtgaccataatgagtgtgttaaaccgccggcaagccttgcagcgagcgctgctcaatgggaaaaacaaacaggatgcgtatcatccgtttccatggtacgaatcgatgagaaaggatgcgcctgtttccttcgatgaagaaaaccaagtgtggagcgtttttctttatgatgatgtcaaaaaagttgttggggataaagagctgttttccagttacatgccgcagcagacaagctctattggaaattccatcattaacatggacccgccgaagcatacaaaaatccgttcagtcgtgaataaagccttcactccgcgcgtgatgaagcaatgggaaccgagaattcaagaaatcacagatgaactgattcaaaaatgtcaggggcgcagtgagtttgaccttgttcacgatttttcatacccgcttccggttattgtgatatctgagctgctgggagtgccttcagcgcatatggatcagtttaaagcatggtctgatcttctggtcagtacaccgaaggataaaagtgaagaagctgaaaaagcctttttggaagaacgagataagtgtgaggaagaactggctgcgttttttgccggcatcatagaagaaaagcgaaacaaaccggcacaggatattatttctattttagtggaagcggaagaaacaggcgagaagctgtccggtgaagagctgattccgttttgcacgctgctgctggtggccggaaatgaaaccactacaaacctgatttcaaatgcgatgtacagcatattagaaacgccaggcgtttacgaggaactgcgcagccatcctgaactgatgcctcaggcagtggaggaagccttgcgtttcagagcgcccgccccggttttgaggcgcattgccaagcgggatacggagatcggggggcacctgattaaagaaggtgatatggttttggcgtttgtggcatcggcaaatcgtgatgaagcgaagtttgacaggccgcacatgtttgatatccgccgccatcccaacccgcatattgcgtttggccatggcatccatttttgccttggggctccgcttgcccgtcttgaagcaaatatcgcgttaacgtctttgatttctgcttttcctcatatggagtgcgtcagtatcactccgattgaaaacagtgtgatatacggattaaagagcttccgtgtgaaaatgtaatagataaggagactggagattcatgaaaaagtaccatatttcgatgatcaatatcccggcatacggacatgtcaatcctacgcttgctttagtagagaagctttgtgagaaagggcaccgtgtcacgtacgcgacgactgaggagtttgcgcccgctgttcagcaagccggtggagaagcattgctctatcatacatccttgaatattgatcctaagcaaatcagggagatgatggaaaagaatgacgcgcccctcagccttttgaaagaatcactcagcattctgccgcagcttgaggagttatataagggtgatcagcctgatctgatcatctatgactttgttgcgctggctggtaaattgtttgctgaaaagcttaatgttccggtcattaagctctgttcgtcatatgcccaaaatgaatcctttcagttaggaaatgaagacatgctgaaaaaaataagagaagcagaggctgaatttaaagcctacttggagcaagagaagttgccggctgtttcatttgaacagttagctgtgccggaagcattaaatattgtctttatgccgaagtcttttcagattcagcatgagacgttcgatgaccgtttctgttttgtcggcccctctctcggagaacggaaggaaaaagaaagcttgttgattgacaaggatgatcgcccgcttatgctgatttctttgggtacggcgtttaacgcatggccggaattttacaagatgtgcatcaaggcatttcgggattcttcatggcaagtgatcatgtcggttgggaaaacgattgatccagaaagcttggaggatattcctgctaactttaccattcgccaaagtgtgccgcagcttgaggtgttagagaaagctgatttgttcatctctcatggcgggatgaacagtacgatggaagcgatgaacgcaggtgtgccgcttgtcgtcattccgcaaatgtacgagcaagagctcactgcaaatcgggttgatgaattaggccttggcgtttatttgccgaaagaggaagtgaatgtttccagcctgcaggaagcggttcaggctgtatccagtgatcaagagttgctcagccgcgtcaagaatatgcaaaaggatgtaaaagaagctggcggagcggagcgtgcggcagctgagattgaagcgtttatgaaaaaatccgctgtcccgcagtaaaaacataaaaaccgaaatcaatttgatttcggttttctgtttaaatattttttttcatcccgcatctccggcattctctaagaaattttccgccttttacagagcttttgaacagtgtgtaatcacagttgtcgcagcgcccgctgcgggcgtccggatattcattgaattcgtaaacaatcgatgtatcgtagccttttgtttcatattcttctttttttgtttccatgtcgatcctccgttacaagacgtgtctgctgtttatcttacagcaagcttccggcgtattcaatggattttaggagtttgggtttatcttgatttctcccttggtttgcgccaaaatagctttaataagcttgtatacataaaaagcctatgcaaagaggagaggaaacgggtatgggaaaagggttacttggaaaacgcgtggcaatcggtggctcacgaaaaacggaagaaatcagtacaatcattgaaaaacagggcggaatacctgtcatccggcctctccaaggtacagtttacttagcagagaagcaggtggagccggatttgcggacgtttgcggaagaaaaagctgactgggtcattttcacgacaggcatcgggctggagactcttgtcgatatggcagagaaaattggactgaaagatgagtttctgcaggccatttgccaagcgaaagcggcatgccggggatacaaaacgctgtctgcgctgaaaaagcttggaatcacaccggaagcttcggatgaagacgggacaacaagaggcttaatccgttctttggagcctcacgacttttcaggaaaaacagtcctggtgcagcttcatggcgaaaaagcgtcggctctcatggcatttcttgaagaaaaaggcgcgtctgtcctgccgattctgccttatcagcacatcccgccggaggaggaaacggtggagcgattatgccgagagctgatgaacggtgagatcgatgccgtttgttttacaacggccattcaggttcgttccctgtttgattttgctaaggggcgaggttatatcaatgaagtgaagaaggtattcgaagaacgcgccatcgcagctgctgtcggaaaagtgactgctgaagcactgcgggaagagggcattacgagactgcttgcgccagagattgagcggatgggtgcaatgattgttgagctggccaagtattatgaagaaaaggaataacaagtacaaaaagccgcttttccctcggaaagcggcttttgtctgtcattcattctgcttcagctgctgatgaacggtgaataatgatgggtatgtcagcacgcttaagattacacaagtcagcgcggctgaggccatcgttgtaaacacgattaagagctgaaagcgtactgcctgaatcgggtccgcgccggctagaatctggccagtcatcatgccgggaagctggacaagacccagtgttttctggctttcgagcgtcgggatcatactcattttcatcgctgaggtaagaatgcgctgtatggattgcttcggtgtgccgccaagtgacaatattaattgaatttcttctttgcgaacgccgacttctgagttaagccggtttagaaacaaacttgagagcaccatcgaatttccgatgaccatcccgctgatcggaatgacatatcgtgccgtaagcggaatgatatgaagagacagcagaattccctgcgtcacaatttctacgattgctaacgcggcaaacaccctccaaaacgaaccgatagtatttttctttcgcttgatgacattttgcgccgccaccgcgagcattaacagcaccatcagcaggataaaaacagggtggtctccgcgaaaaatcagcgacaaaacataaccgatgataagcagctgcaccgcggcccggatggtggcgatgatcatgtctttttctacaccggctttaaaggattttgataaaaacaaggcgatcaaaacaaagatcatcgttaaagagagagaaaggtaatccattaccgagtgcctcccttcaaaaattctttcgctgcttcatgctgcggagcggagaaaaatgtttcggtttcagcgatttcaagcagccggccatctgccataaaccaaatggtatcggctattcgttttgcctgctccatattatgagtgacccacatgactgtccattttttctcttgatgctgacgtttgatcagttcttcaatctcaagagcagaaaccgggtccaaggccgatgtgatttcgtccaacaatagaatggaggaaggatttgagagcgttctggccagtgacagtctttgccgctgcccgcccgataagtctctggcgcttctgtctaacagctctggcggcagccctgcaagagaagccagcttttcaggagagtacagctgggattgatgcagcctttgtacaagacttaaattgtcacgcactgtcccgtcgagcacgggagccgattgaaacgcgagggctgccgttcgcctcagctcattgacattccattctctgacttcctttccatatatgttgacttcgccgctgtcaggcgttctcattaaattacacatagaaaggagggtgcttttgcctgagccggaagggcctaaaacggctacgattgcgccctgttgaatgtctccggtgacatcctgcagcacatcataggtttgtccatcttgtttatagctttttctgactgatctgaaggagatggctggtatgttttgtgtttgatcgtttgcttccattacaataatcacctttcaatataagtaggctgacattatatttaactataacgtgaaacagattccttttggtagcacaaataaaggagaacaggctttcacccattctcctgcagatgctacgcagtcagatttgactgtgctttctttttcggttttctcggctgtgaagcgaaggtatgtaacatcatccctgctattataatgaataaaccggcaaatgataaaagagatgggaaaacgcctgacagcagaacaatttcaccaagcagcgcgaaaatcacttcaccggattgagtggcttcaacagctgcgagtttttgaggattgtctcttaccatatcagtggcccagaaaaataaaatcgtcgcaatgatgcctgagctgatggcaacgataaggattgaacggtttgacttgctgtggaaggccatctgaccaccagccgtaagctgctaatataagccagaatggaaggcttgccaatgtcattccaagcacgcgctgaaatgtatcaagccggcctccgtattcttcgagcattctcctgtttcctaacggataggcaaaagccgcaatgacaaccggcagcacactgaaaagaagagtgaagccaatattccgataacgatagctttcatgatatccctcattctggcattatttttttatactatacaattcggtatcatgcagatcaatggaatcatgagaaaaacatcatgttttgagaaccgctatgtgtggaagacaaaaaagggaggtgaaattgatggaaaaagagacacagacatacttctttccggatgacggcaggattccgaatcaccctgattttccgctcgtggtgtatcaaaacgcgcttaaggacaccggactggcagagcggatcgtcatccggcatggctggtcaaacagctggtcagggagtgtttttccataccatcattatcacagcaatacgcatgaagtcctgattgcccttaggggagaggctgtgattcagtttgggggagaaaaaggggctgccatccctttcaaatcaggcgacgcagtcgtgattccagccggagtcggacataaaaagctcagctcaagccccgattttactgtccttggcgcctatcccggtggcgttcagtatgatatgaagacggggaaaccgaatgagcgggaggaagcgctcaaacagattaagcaggcggcgttgccggcgaatgatccgatcacaggaaaaagagagcctctattggaaatatgggtaaagtgaaggggagaaattgctggattgtcaataactagtgccgcagaaacgatatgacatgagctccatataaattaatttcataatcgaagcaattcacgttcaaattttgttcaaaaagtgttatcatatagaaggtaatcgaattggagttttttgtgtttgctattttcagagagagtaaaggattttgacttattcaattgtttatttttagataaaaataatactgaatatggcaagatgaaaaactgggtagtaaacatttatttttgtaaatgattgtgcacgaattcacaatccttattcttatgccttaaaagcgtgagacagggagaggcactaccctttccaaaaaaatcagcaaactgcttatagtaaaggagaattggatatgccagaaacaatcgatcaaacaaatgcgtctgtcagccaaagccagcaagatcttattgatcagctattaaagccagaagttcaagaatcattgactgttttagttgaccagcttccgaagctgactgagttagtgaatattttaacgaagtcttatgatttcgctcagtctgtagcgactgacgaagtgttaaagagcgacacagtcggtgcgatcactgaaattctcgagcctgtaaaagaaacagcgaaagaagtagctgcgactgcgatcgaagcaaaagaccgcgcggaagcaagcaacgaaacaattggacttttcggccttcttcgcatgctgaaagatcctcaagctcaaaagctgttccgttttgctaacagctaccttgaagtcatgaacgaacgcgaaaaccaaaaataatctcagattcaaattgatataaaggacggaggatatacgatgtcaaaacatattgtcattctaggcgctggttatggcggagttctttctgctctaacagttcgcaaacattacacaaaagaacaagcacgcgtgacagtggtaaacaaataccctactcaccaaatcattacggaattacaccgccttgctgcaggcaacgtgtctgaaaaagcggttgcaatgccattagaaaaacttttcaaaggcaaagacattgatcttaaaattgcggaagtaagctctttctctgttgataaaaaagaagttgtgcttgctgacggttctacattaacttacgatgcgcttgttgtaggtcttggttctgtaacggcttacttcggcatcccaggtcttgaagaaaacagcatggtattgaaatctgctgctgatgcgaacaaagtctttcaacatgttgaagatcgtgtgcgcgagtactctaaaacgaaaaacgaagcagatgcaacaatccttatcggcggcggcggcttaacaggtgttgagcttgttggtgagcttgctgacatcatgccgaaccttgcgaaaaaatacggcgtggaccataaagaaatcaaattgaaacttgttgaagcaggtccgaaaatccttcctgttcttccggatgatcttatcgagcgtgcgactgcaagccttgaaaaacgcggcgttgagttcttaacaggtcttcctgttacaaatgtagaaggaaacgtaattgatctgaaagacggatctaaagttgttgccaacacatttgtttggactggcggcgtacaaggtaacccattagtcggtgaatcaggtctagaagtgaaccgcggacgcgcgactgtaaatgacttcctgcaatctacatctcatgaagatgtattcgttgctggagacagcgcagtttacttcggtgcagacggccgtccatacccgccaactgcacaaatcgcatggcaaatgggtgagctgatcggttacaacctattcgcttacctggaaggcaaaacgcttgaaacattcaagccagtaaactctggtacacttgcaagccttggacgcaaagacgcggttgccatcattggtgcaaattctacaccgcttaaaggtcttcctgcttccttgatgaaagaagcaagtaacgtacgctacttaacacacattaaaggacttttcagcctggcttactaatcctttttatgaatttgacattgccaaaagcgttcctttccgggtgctttctggcaatgtctttttttgtttatatgctaacgttaacatttcattttcaaaaaagagattgatcccagaggaatataaaggtaaaatagatacaaatcaaaatgttaacgttaacattttgaaatagaatgaaagacggtgaggacatggaacccttcatgggcgaaaactttttattgaaaaatgaaaccgctgtcagcctctatcataattatgcgaaagacatgccaattattgattaccactgccacttaagtccgaaagaaatctatgaaaataagacatttcaaaacatcacggaagcctggctgtatggtgaccattataaatggcgcatcatgagagccaatggaattgaggagacatacatcaccggagatgcgcctgatgaggagaaatttatggcttgggcgaaaaccgtgccgatggcgattggcaatccactctacaattggactcacttagaattgcagcgtttttttggcatttatgagattttaaacgagaagtccgggccggctatatggaaacggacaaatgaactgctcaaaggggagggcttcggggcaagggatttaatcgtgaaatcaaatgtaaaggttgtgtgcaccacggatgaccctgtcgattctcttgaataccatctattattaagagaagacaaagactttcctgtcagcgtgctgcctggatttcggccggataaaggacttgagatcaatcgtgaaggctttactgagtgggtgcaggcgcttgaagatgccgccgccatatccattacaacctatggtgagtttttaaaggcgttggaaaaacgagtgcgattcttccactcagccggcggcagagtttctgatcacgcgatagattcaatggtatttgccgaaacaacaaaagaagaagctggacggattttttctgacagattacaaggaacagaggtttcttatgaagatgagaagaaatttaagacatatacgcttcagtttctttgcggtttgtatgcggagctcgattgggcgatgcagtttcatatcaacgctttaagaaacacaaatacaaaaatgatgaaaaggctcggacctgatacaggctatgattcaatgaacgatgaagaaattgccaagcctttatacaagctgctgaactcagttgagatgaagaaccagctgccgaaaacgattttatattcactgaatccaaatgataactatgtcatcgccagcttgatcaacagttttcaggacagtattaccccgggaaaaatacaattcggcacagcctggtggtttaacgatactaaagacgggatgctcgatcaaatgaaagcgttatcaaatgttggccttttcagccgttttatcggcatgctcaccgattccagaagctttctttcgtatacgcgtcacgaatatttcaggcggatcgtctgcaatttgattggagaatgggtggaaaacggcgaagtgccgcgcgatatggaacttctgggaagcatcgttcaggggatttgctatgacaatgcgaaacactactttcaatttcaagaagagaaagcaaacgtgtaacaaagtatccgctcagtatccctgagcggatcactatccgaaaattcttaagacacagaggtggaacatgcgaactgaactggcaaataaggttgtgtcggtcgaaacggaaaaaaggctttcattgaaagagaaaatgtcctatggttttggtgattttggcaatggttttatgtttgatctcggccagatttatttattgaagtatttcactgatgtagcgggaatccccgctgcgatggccggcggcatttttttagtcagtaagctgtttgcagcgataacagatccaattgtcggctcatcaatcgattatcgcaaaaacatcggcaaacgggggaaattcaggccttatctattaatcggcagcatcgtgcttgcggtgcttactgttcttatttttctgtctcccaatgtatcaacgaccggaaaactgatttatgcatatgcatcctatatgatttggggcatcggctattcgtttgtgaatattccgtacggctcattaggggcagcgatgactcaaaattctgaggaccggacctccatttcgacgttccgccaaatcggatcacttggcgccttgtttatcacaagtgttgccgtgatgccgctgctcatcaagtttgataatccgaaggtcggctacccggtggtcatgggcttgttcgctgcactcggtgtgctttggttttatatttgctaccgcaactgcaaagagcgcattgtcatatcggaagcacccaaagaaaaattaacactctcatctgtcgtcaaaacatttattacaaataaaccgctgttaacccttgtcctgatgacggttttttcaatttccgcatacaacattaaatccgccatgctcgtctatttcgcacaatataacctgggcaatgttgaattaatggcttatatgaacttcataattatcggttcttcctttttgggcgtcgtattccttccaaagctcgtcaagatgtttggaaagaaacgaacggcaatgatcggcttcggcatcagtgtggccgcggatctgatcaactttatgcttccatctaacgtttatgtgtttacaattctcgccagtatcgcctttattggaatcagtatcccaaatggcatcacgtgggctcttgtctccgatattatcgactatggcgaatggaaatccggtgaacggaaggaagcaacgacatattcacttttcaatttctccagaaagcttgctcaatctttgtctggctttctctcggggatcggtttggggattatcggctatgttccgaatgcagtccagacagcacaggcgctgattggcatcaaagcgctgcttcttctgtatccggccattgctttggcattagcgatgatcattatcggctttctttataaactcacagaccagcagcatgctcagatcgttcaggatcttcatcaaaagtactgacaatataatataaagaatatttaaaataatttgtaaataaaatgtgtttgtaggggtttcgctaggggagtgcccaaaaaactgaaaaggaaggaggcacttgtttgaaaacgataacaattgcagctgaagaagcaaagggactcgttcgacaaaagctggccggtgccggtttgaatgaacgagatgctgaaaaagtagcagatgttctcgtgcacgctgatttgcgcaatgtacattcgcatggcgtgctgcgcacagaacactatgtgaacaggcttttagcgggagggatcaatcctggggcacagcctgtttttaaagaaacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgctcggaatggcaatgacgcatacagacagtatcgttgtcccgtttggggggaggactccttttttagggacaaacccgattgcttacggtgttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcggcggcccgaaaggctatggactatcgattgtggtggatgtattttcaggattgctggcgggcgcggcttttggccctcatattgccaaaatgtacagcggccttgatcaaaaaagaaagctggggcattacgtttgcgcgatcaatccagccttttttactgactgggatacgtttttagagcagatggatgccatgattgatgaactgcagcaatcaccgccggctgttggattcgaaagagtgtatgtgcccggcgagatcgagcagctgcatgaagtaagaaataagaaaaacggaatttctatcgcccggagcgtgtatgaattcttaaaaagcaggtgagtaaaatgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgctcgctaccctcccgagagttatcggacacgaggtaactggacaagtggaggcagttggtgcgaatgtacagagcctaaaacccggtgatcatgtggtgattgagccgatttcttattgcggatcgtgctatgcctgccgcaaagggcggccgaatgtttgcgccaagctttctgtatttggcgtacatgaggacggaggcatgcgggaatatattgtgcttccggaaaggcagcttcacgcggtctcaaaggacttgccttgggaggaagcagtcatggccgagccttatacgataggcgcccaggcagtgtggagaggccaggtggaaaaaggtgataccgtcttgatccagggagcggggcccatcgggatctgtgtgttaaaaatggcaaagctggcgggcgctgctgtcatgatgactgacttgaacaacgagcggctggcatttgcgaaagaaaacggcgccgatgctgttgtaaatgtccaagcagaaaatgttgccgagcgggtccttgaatggactgggaatgaaggagcaaacgtggtcattgatgctgtttgcctgccggagacatttgcgctttcaattgaggccgtatcaccggcgggacatgtggttgtgcttggatttgatgaaagagcggctcagatttctcagctgccgattacaaaaaaagaagtcacgataaccggatcccgattgcagaccaatcagtttccaaaagtagtagagcttttgaatagaggccagttagtgcataacgggctggtgacccatacattttcagttgatgacgttcatcatgcatttcagtttattaaggagcatccagatcaggtgcggaaagccgtcatcacgtttgattaaatgactgaatccggaggtgcgagcatgaatatgacattccgatggtatggacgaggcaacgatacagtcacacttgaacacgtgaagcaaattcccggtgtcaaaggcatcgtttgggctctccatcaaaagcccgtcggcgacgtgtgggaaaaagaagaaatcagagccgagactgaatatattcaatcctatggttttcatgctgaagttgtagaaagcgtgaatgttcacgaagcgattaaacttgggaacgaagaacgcggccggtatattgaaaactacaagcaaacgatccgcaaccttgccggatttggcgtgaaagtgatctgctataattttatgccggtttttgactggacacgcacggacatgttcaagccgctagaagatggatcgaccgctctgttttttgaaaaggccaaggtggaaagccttgatcctcaagagctgattcggacggtggaggaagcatccgacatgacgctgccggggtgggagcccgaaaaattggctcggatcaaagagctttttgctgcctacagaacggtcgatgaagaaaagttatgggacaatttatcattctttttgcaggaaattcttcctgttgctgaggcctatggtgttcaaatggccattcatccggatgacccgccgtggtcgattttcggactgccgcgcattatcacaggagaggcaagctataagaagctgcgggcgatatcagattcaccgtctaattgtatcaccctttgtacaggttcaatgggagccaatcccgctaacgacatggtggagatcgctaaaacgtatgccggcatcgctccattttcacatattcgcaatgtgaaaatttatgagaatggcgattttattgaaacatctcatttaacaaaggatggttcgatcaacattcaaggcgtgatggaagaactgcataagcaggattacgaaggatatgtcagaccggatcatgggcgccatctttggggcgagcaatgccgcccgggatatggcttatacgatcgggcacttggcatcatgtatttgaacgggctgtgggacgcctatggagtaatggcaaaaaaagaggtgggcgtatgatcccgctgcatgagaacctggctggtaaaacggctgtcatcactggcggcagcggcgtgctttgctctgcgatggcccgggagctagcccgtcatggcatgaaggtggcgatattgaatcggacggctgaaaaaggccaagcggtcgtgaaggagataacggcggctggcggcacagcgtgcgctgttgctacggatgtgctggacaggatgtcactggaacgggcaaaggaagacatccttggccaatttggcgctgttgatctgttaattaacggggctggcggcaatcatcctgacgcgataaccgatgtggagacatatgaagaagcgggagaaggccaatctttttttgatatggatgagaggggctttctaactgtattctccaccaatttcaccggtgcgtttctggcctcgcaagtgtttggaaaagagctgctgaaagccgattcaccggcgatcatcaacctttcttccatgagtgcttattcacctatgacgaaggttccggcatacagtgccgcgaaagcatccatcaataattttacgatgtggatggctgttcattttgctgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaacccgaggatttgctcggtacgcttctttggctggcggatgaatcctattccggttttgtcactgggatcaccgttcctgtcgatggaggatttatggcttattcaggtgtgtaacgaaagcggtgcaacagaaactgaaccaacataggggtgaggttgagatgttttcaaaagataagcttcccgttatcctttttttgttcctggcaggggtgattaattacctggatcgctcggcgctttccattgcagctccttttattcaggatgatctcacattgtctgccacgcaaatgggcttgattttcagcagtttttcgattggttatgcgatttttaactttcttgggggcgtggcatccgaccgctatggggcaaagctgaccttgtttgtcgcgatggttgtttggtcgctgtttagcggagcagtcgccctcgcttttggctttgtcagcctgctgattatacgcattctcttcggaatgggagaaggcccgctttcggcgaccatcaacaaaatggtgaacaactggttcccgccgacccagcgggcgtctgttatcggtgtaaccaacagcggcacgccgctcgggggagccatttccggcccgatagtcggcatgatcgcagtggcgttcagctggaaggtatccttcgttctcattatgattattggattgatatgggcagtgctctggttcaagtttgtcaaagaaaagccgcaagagacgatcaaggaagcaccggcaataaaagcagaaacgtctcccggagaaaaaattccgctcaccttttacctgaagcaaaaaacggtcctgttcacggcgttcgcttttttcgcttacaactacatcctcttcttctttttgacgtggtttccgagctatcttgtcgacgagcggggattaagtgttgaatcgatgagtgtcatcacggtcataccgtggattttaggatttatcgggctggctgcagggggatttgtttctgactatgtgtacaaaaaaacggcccgaaaaggtgtgctgttctcgcgcaaggttgtgcttgtcacgtgtttgttttcatcagctgtcctgattggttttgccgggcttgtggcaacgactgcgggggctgtcactcttgtcgctctgtcagtgttctttctttatttgaccggtgctatctattgggctgtcattcaagatgtggttgatcaaaacaatgtcggttctgttggcggcttcatgcatttcctcgccaacacggcaggaattatcggcccggctttaaccggatttattgttgaccaaacaggcacgttttctggagcatttttgcttgccggagggctggctgtcttcgcttcacttgctgtgattcgttttgtccgtccaatcatcggcaagacagcgggaacagaagcggaaaaccctgtgtcttattaatctggaaatacagtgggagaggcggtatgtttgatgatacaatatacagtaaataatcgcagccggtatgataaggaagggaattagatggtaaccataaaagatatcgcaaaactcgcaaacgtatcccacacaaccgtttccagagcactcaacaacagcccttacatcaaagaacatacgaagaaaaaaatattagagctagcagagcagctcaactatacaccaaatgtaaatgcgaaaagtctggcgatgcaaaagtcgcatacgatcgggcttttctttacaagcattacaaacggaacctcacacagcttctttgcagacacaatcaaaggcgtcaatcaagccataagtgaggattacaatctgtatgtgcgcggcattgatgatctgaaaaactatgactccgttacaccgatgagatatgacggcatcattttaatgagccaaagtgacattgataattcttttatttaccatattcgcgaaaaaaacattccgcttgtcgtgctgaatcgtgatattgatgatcgcaccatcacgaatattttgtccaatgacaaggaaggctctcaagaagctgtagaatacttcattcagtccggacatcaagacatcgccatcatcgaggggatcgaaggctttaaatcctctcagcagcgaaaggaaggctacttatctgcactgattcaacatcatattccgatcaagcatgaatacagtgtcaaaggacagtacgatatggaaagcggctttcaagcgatggagcggctgctggcactgccgaatcctccaaccgctgttttttgttcgaatgatgacatggcaatcggagcgatgaatgcgatattcgcaaagggcctgcgcgtccctgatgatatttcggtgatcgggtttgatgatattgggttttcacagtacatcacgccaaggctttcaacagtaaagcgcccagtggagaaaatcagcgtgcttggcgcgcaaaaactcttgtctctgatcagcaagcccgaaacaaaagcagaaaaaatcttggaaaacacagaatttatggtgcgtgattcagtcagacgattgacgacgtgatgtcccgtttttcagcgggcattctttatacagaaaaatgttaacgtgtgcataaaaagagggaggcaataagggtgcagaagctgaataaaaatgtgtacgatcactatactcagtatccagaaaaaattctccaattcggagaaggaaactttcttcggggatttatcgattggcagattgatcaattgaatcaacacactgattttaatgggagtgtggcggttgttcagccaaggggttcagaaaaaatcaaacgattaaatgagcaagatggattatatacgctttttttacaaggaatgaaagatggagaagcggtaaacgagcatatgattatcaactcaatcagccggggaattgacctgttttctgattatgaagcatacaaagaattggcatcaagcgaagagcttcggtttatcatctccaacaccactgaggctgggattgtatgtgatgaaaaagatcgtttagaggataggccgcaaaaaacattccctgggaaattaactgcatttctctacttccgctatcaggcttttaaaggagatcagacaaaagggtgtgtcctaatcccatgtgagctgatcgagaagaacggtgaaaagctgaaggaaacggttattcattatgcaggtctgtggaagcttgaggaaggatttacacagtggattcatgaggccaatacgttttgtaatagtttagtagaccggattgttccgggttttcccgtcgacagcattgatgagatcacggcagatcttggctatcaggatgatttgatagttgtgggagagcaatattatttatgggttatcgaggggcctgattggattggaaaagaacttccctttgcggctgcagggctgcatacaaagatcgtcagcgacctcaccccataccggactaaaaaagtaagaattttaaatggcgctcatacagcaatgacgccagtggctttattatacggcttgaagactgttagggatgcagtggagcatccggaagtggggcgatttataagagagctgattgatgacgaaattcttcctgttttaaaaatggaaggtctttctcagtatgctgacgatgtgctgaaccgttttaaaaacccgtatattaagcattacctggaaagcattgcattgaacgccatttccaaattcaaaacgagaaacctgccgactcttaaggaatatgctgaacaaaagggacagcttcctgaacgcttggtgttttctttcagcgctcttctgtatttttatcataataatgagacattgcaggatgatccggcagtgcttcaatttttcaaagaggtttggtgtcaggaggatgacgacatgcttcggattgcatcaagagtgttaggcgaacagcggctgtggggggcagatctcaatgagataccgaagctgactgatagagtcgctgtttacttgaatcatattcatgagctgggcatgcagagggctcttgaacaatactgcatacaagggggagaggtacgttgaagtcgtttataaagattcataagcaagataatgtccttctcgctctgcgggatattcaaaagggagagaggctgtatgcggacggcgtgtcgcttgaagtaaaggatgatataaaaagaggccacaagattgcattgcagcctattaaagaaaatgacagcatcatcaagtacgggtttccaattgggcatgcaacacaagatatctcgatcggagagcatattcatgtccataatacgaaaacaaacctgtctgatatccaatcatacagctatacaccgagatttgatgaaaatccgtattctaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatatcactccatttgataacgtactggtgttaaagcatcaatacggatgctcgcagcttggcgacgatcatgaaaatacgaagcaaatcctgctgaatgctattcgccatccaaatgccggcggcgtcttggtgttagggcttggctgtgaaaacaatgagctggcaagaatgaaggaagcactgcaagatgtgaacttgaagcgggtgaagtttctggaatcccagtcggtgaccgacgaaatggaggcaggcgttgctttgctgaaggaaattcatgaagcggccaaaggagataagagagaagacattccgctgtctgaactgaagatcgggctgaaatgcggaggttcggacggtttttccggcataaccgcaaacccgctgcttggacgtttttcagattatctcattgcacagggagggagtactgtgctgacggaagtaccggaaatgttcggagcagaaaccatcctgatgcagcggtctgccaatgaagaagtgtttcataagatagtcgatttaatcaatgatttcaaacaatactttattaaacatgatcagccggtgtacgaaaatccctcaccgggcaacaaagcgggcggcatttctacacttgaggataaatcgctgggctgtacgcaaaaagcggggatttctcctgtcacggatgtcttgaaatacggtgaagtgctcaagacaaaaggactgacgcttttgagcgcgccaggcaatgatttgatcgcctcctccgcattggctgctgccggctgtcaaattgtcctctttacaacgggaagaggcacgccgtttggcacctttgtcccgacggtgaaagtagcgacaaacaccgagctgtatgaggcgaagccgcattggattgattttaacgcaggccttttagcagaggatgatgttcatgaggaatatgtgctgcgtgagtttatccactatatgattgaggtggcaagcggccagcttgtgaaccatgaaaaaaatgatttcagagaactcgccatttttaaatcgggtgtgacgctataataagaaaaggctatccttcaagcggatagccttcttcattaaatcaattttaaaccgctgactaaaataatggacgccataataaattgcagtggacgcggggagaatcgaggcgaaagatggcttccgatcagcacgccgggaattgaaccaatgagcagattagctgccagcatgtaatccacgcttccgaagcttgcgttcaaaatgcctgctgccgtaacaagaagaaatgcatgcgcgatatcggttccgacaatctgtgacgctttcatgttaaataagtaaatcatggcgattgcaaataatgagccggaaccgattgatgttaatccgacgataaacccaaacacaacaccaataagaattgtcagcgccctcttattttcaagcggcatcagctgccagcggttggggcgaagttttctgtccaaaaacaaacgaacgatgattgaaatggcaaccagcgttaacacatatcctagagcgtgcttaataatttcttcctgatgctggtgaaaggcggggaacaaatgcaatatgccaatggctagcgaagcactcggaatactgccgatggccaagtattttaccaatttaaagttaatcgttttctgccgccaatgggaggcaacgccaaacagctttgtgatcgagttatatacaagatctgtaccgaccgcgatggaaggattaattccaagcacaattaaaaggggagttaataaggccgctccacctactcccgtcaatccgactaaggctccgacaaacaaacccatcaatatgatgcttacactcatgataaaggcctcctgaaaacccgactatttttatcagattatatatgattaggacgcgttaatcaattaaattttttgaatttttgcacgtcagctgcttggaattttggtatgctcaatatctctattcatttgccctataatgagtgtctggacgaaatcgagaagtactaaaggcgcaaaaaaaagatacctcttaacaggtatcttttttcttgtttacgctacatgcgctgctgatagaaaggaagctcagtgtggcccatttcccgcacatacacgaacaggttgcctttatggtgaatttcatgctccattgcaagctgaagcagcgcgcggcctgtgacttttctgccgaaagcggatgtcagatcaatttctctgtccagctgctcttcagtcagctgttcaaggatagcggccgttttttctgtatatgtttttgccagaacattgagatctgtttctgtttcttcctgcttgttttgaaatggtgaggcattgccttccttaatgacatttgcgaacaagtggaaagacgtaagaatgtgtttgaccagctcttctgctgacattgatgtttctgccggtttgtagctgtaatggtctttgctgattttttcggcaagctcattggtcacgtttcgatgggataaaaaatggctgacaatttgattggattggctcattatgatctcctccatatgtaaaaataaatggtgcaatgaaatcctatatcaacggttatgaattcacaagtaatatgctgtgggatgaaacaaaatgctatgtcaatcgtatatataacgttcacaaaacatgaaatggagtataaacatgactaatatacctttcatttatcagtacgaagaaaaagagaatgaaagagctgcggcgggctacggcactttcggttaccttatcacacggattgaagaaacgctttatgatcaatacggtgtattctatgagctctatgccagtgatgatccaaatacggaatactgggagcttcttgtagaagatgtccgcagcggttcattggagcctgagcatgtggcatatatatttgaaaagcttgaaaagaaaacctttgcttacgatgaagatgagaaagaaccggattataccgtccataagtctataagaaacagtgtatacgcatatcctgaaaagggagttgcttttgccagaattccatattttcaagatgggagcattatgagttttgattgtctgtttgcggttaacgatgaaaagatgcgtgcatttctggagggagtcagaccgcgtctttgggaaaaaagcaagcgaaaagtgaccgtgtttacggatggagatggagggacttcaagagagcaggaagccattgtcagagaggttcagcggagtcaagtcatcatgaatccgctattgaaaaaggagatatacagatcaattgatcagttttttcatagtgataaatcgttttatcaaacatatgacatcccttacaagcgcggcattctgttatatggacctcctggaaacggaaagacgacgttagtgaagtcgatcgcaggcagtatcgatgcacctgttgcttattggcaaattactgaatttacgtcgagcgagacaatagaagaagtctttcaggcagcgagacgcctcgctcctgcagttctggtcatcgaggatatagattcgatgccggaagatgtgcggtccttttttctcaatacgctggacggcgcgacatcaaaagaggggctatttctcatcggtacgacaaactatcccgaagagatcgatccaggtttgatgaatcgtgcagggcgatttgaccgtgcctatgaaatcgggcttccggatgaagagctgcggctggaatatatgaaaatgagaggctttggcatctttttgagtgaaggagaaataaaaaacgccgcaaaacttacagaaggcttttcctttgcacagctgggagaattatatgtatcttcagcccttcaatggcaccaagaagggaatcatcatattgaaaccatggtgaaagacatgacaggagagcaaagaaaaagccagcggggaagctggatggaaagaaacaaagtcggttttcactaaaagaaagcacgggtgtttgaaaaacccgtgcttttttgttgcggttagccgaaattcgacaattgcggttattttgcgttcttctttttcttgcaaatatgataaaatatgacatatctcgggtaattcaaaaagggggattaattgaggatgaagcagacgattccgtcctcttatgtcgggcttaaaattaatgaatggtatactcatatccggcagttccacgtcgctgaagccgaacgggtcaagctcgaagtagaaagagaaattgaggatatggaagaagaccaagatttgctgctgtattattctttaatggagttcaggcatcgtgtcatgctggattacattaagccttttggagaggacacgtcgcagctagagttttcagaattattagaagacatcgaagggaatcagtacaagctgacagggcttctcgaatattactttaatttttttcgaggaatgtatgaatttaagcagaaaatgtttgtcagtgccatgatgtactataaacgggcagaaaagaatcttgccctcgtctcggatgatattgagaaagccgagtttgcttttaaaatggccgagattttttacaatttaaaacaaacctatgtttcgatgagctacgccgttcaggcattagaaacataccaaatgtatgaaacgtacaccgtccgcagaatccaatgtgaattcgttattgcaggtaattatgatgatatgcagtatccagaaagagcattgccccacttagaactggctttagatcttgcaaagaaagaaggcaatccccgcctgatcagttccgccctatataatctcggaaactgctatgagaaaatgggtgaactgcaaaaggcagccgaatactttgagaaatctgtttctatttgcaagtcggaaaagttcgataatcttccgcattctatctactctttaacacaagttctgtataaacaaaaaaatgacgccgaagcgcaaaaaaagtatcgtgaaggattggaaatcgcccgtcaatacagtgatgaattatttgtggagctttttcaatttttacatgcgttatacggaaaaaacattgacacagaatcggtctcacacacctttcaatttcttgaagaacatatgctgtatccttatattgaagagctggcgcatgatgctgcccaattctatatagaaaacggacagcccgaaaaagcactttcattttatgagaaaatggtgcacgcacaaaaacaaatccagagaggagattgtttatatgaaatctaaatggatgtcaggtttgttgctcgttgcggtcgggttcagctttactcaggtgatggttcatgcaggtgaaacagcaaacacagaagggaaaacatttcatattgcggcacgcaatcaaacatgatgcataaaaaagacccttaagggtcttttttatttcttcagcttccattcttttatcgtcagctcaggagatccacttgccaccagcggatccgcatgcccgatttccgctgcctcttccagtgaacctgcttcgatgacatacgctccgcctgtggcgtcgctgaatggtccaaacatttttaaacgcttttctgcctgtaaacgatccagaaattcatagtgcccagccacatgctcctgattaaatttctccgttctcattgtcagcattaaatatgtatacatattcagaccctccatgaacttcagtttaacacatttatccatattacggtgatagatgatatgagcttttcgtcctacgaatgccacctatttatgaaaaaagaaaaggagagatgataggtgagcattccagtaaagaaaaatttggtttctgaggcgaaatacgcgttgaagtgtccgaatgcaatgtccgctgaatacattaccattcacaacacggcaaacgatgcgtcagcggccaatgaaatcagctatatgatcgggaacacaagctcgacaagctttcattttgcggtcgatgatcaagaggtgattcaaggtctgccgcttaaccgaaacgcctggcacacaggtgacggcacaaacggtccgggaaaccgcaaatcaattggcgttgagatttgctacagcaaatcgggaggcccgaagtatgaggcagctgaagccttggcgatttcatttgtagcacagcttttgaaggagcgcggctggggcatcgatcgggtgagaaagcaccaggactggaacggaaagtattgcccgcaccgcattttatcagaggggcgctgggatcaagtgaaggcggcaattgaaaaggaattaaacgggggcgtatcagctaaaaaagctgcagtctcttcttcagcgtctgaatatcatgtgaaaaaaggcgacacattgtcagggattgccgcatcacacggagtcagtgtgaaaacgctgcaaagcatcaatcatatcactgacccgaaccacatcaaaatcggacaggtgatcaaactgcctcagacggcatctgcttctaaaagccatgccgcatcctcatatccgctcccatccggcgtgatcaaagtgacaagcccgctgacgcaagggacaaaagtaaagcaggtgcagactgctttagccgctctttatttttatcctgataaaggagcgaaaaatcacggcgttgacggcgtttatggcccgaaaacagctaatgcagtgaaacgttttcagtctgtcagcggtttaacggctgatgggatttacggtccgaaaacgaaagcgaagatggaggaaaagctgtaaatgaaaagacggaagctgtgaagcttccgtcttttcgccttacatacaaactgcggcaagcaccttttgaatatcataaatgctttcatcttttttaaactgctttgagacagcgggaagttccgcgccggagatccaaattttcagctctgaatcaaggtcaaagcggccggcagtttccacgctgaatctggaaatgcttttgtacggaatcgattgaaattccgttttcttgcctgtaattccctgtttatctacaaggataagccgcttgtcagtaaagacaatcaaatcgcgaaccagcttaaacgcggcttcaaccttctcaccctcaagtaaaatatgggcaagctcttctttcacagctgccgttgacagtgttgatgcattgccgagtaatccatcaataaaccccatcatatacctcctctgcgtattctatcaaatcatactataaaaaaggttttcattcatagatgagtagagtaaactggtgctgactggtaaaggggggcgttcaagatggaagatatgtatgacagctttgcggccctttctgcttctgagtcggagtaccggattatttatgaggagaaaaacggaagtgagcttatcgtcctcggtcctcacggcggcagaattgagcctggcgtcagtgaactggtgcgggcattttcggatcgatgttccatctatttgtttgagggtctaaagcagcgaaacaaccgttccttgcatctcactagcattcgttttgatgagccgctggctttagaaaaagtgaatgaccaccattacgcattagcgtttcacgggtattatgatccgaaaatcccgcatacattggtcggcggggcggatcgtaaaaaagccaagctcatttgtgagcgtctgaatgaagcgggtttcagcgccgagctcactaatgagaaagaccgcctggcaggtgtacacccaagcaatattgtcaatcggacgaaaagagaaatgggactgcaattggaggtaagcacggcacagcgaaacgcgctattccgcaattttgggtgccgtgataaaagctacatacaaaacgatttgtttgatcgatatgtggaagccgtcaagcttggcttttataaataaaactagacgggacctgcacggtgggcctattccttcatacgctggggttgtgcgaaagtgtggggaggaatgattcatgttttatcatataaaagagcttcaatatcaagcaaagccagctcatcctgatccggtttatgcgaaaaaacttcaagaggtgctcggcggccaattcggtgaaattagcgtcatgatgcagtatttgtttcaagggtttaactgcagggcggatgctaagtataaagatttgttatatgatgtggggaccgaagagattgggcacgtagaaatgctggcaacgatgatttccagacttctggacaatgcacccgcggatgtacaggaggatgcttataaaagcaatcccgctattgcagcagtcatgtcaggtatgaatcctcagcacgcgattgtgtccggattgggggcgatggcatcagatagtgagggctatccgtggaatgcaaaatacattatctcaagcggaaacctgctggccgattttcgcgctaacttaaatgcggaggcccaaggacgccttcaggtgacacggctttatgccatgaccgatgatccaggggtaagagatatgctgtcatttttgattgcaagggatacctatcatcaaaatatgtggtacgcggccattaaagagctggaggaaagagaacgggatattgtcgtcccgacgacgtttccgcgtgagctcgaaaagcaggaagtctcctatgacctgtttaacttttccaggggagatgaaagctcgcaaggaagatgggcacatggggaagcctttgacggccggggtgaattcaggtatatcccggctccgattgcgttcgcatctgcgcctcatcttaaaccggcgcccatgtggctgcataatacagttcccccaatgtcgaaatgttaggttctcttctgggctgaggaatatatcctcagcccttatttgatcagatgtttttaccaatatgatataacgctttttcctcagcgacctgcaagtgctgctgatcgccttcctcgtacgcatgtggccgcttgtgagataataaataagcgagccgcttctgaaattgaatacctgctttacgccgttcaaacatgtcaagccttttatcagcaaattcctttgttacccggaataccgccgcaattgtggcgagtgcctggcttctccattgcggcagttccatctgcaacagcataaaggttggcacacagaagtggtacataaattgatttgcctggaattcctgaagctctctgaagagcttgttcatctgaaaatgattgcctgcatgctttaacacgtggcacagctcatggccaaaatcctcccattgctcttcccgtgactttttttggttcaatacgatactgtacatgccgtcgtatttcaccatcatgctccccatatcctcaaaatgcacccaaatatccagatcctttgcgattttcagcatgtcaatgtgatgaggggatgtgatgcccagccggccgtataaatttttaacgtattcctccagatgtgataagtaatcgcccaattgaatactccctttcgaacatttgttctgtttttagcgagaaagaaaagcccgtataggactggaaagtagtgtagaaatctttcccttttctttaaaaaataaacacttttttctttatatcggtctactttttatatgttttagagaacagagaacgatttatttatttttcggtttgcggtttttctctttttcttttaaatagttgataaattcgatggcctgctgtttgctttctggggaaaaatcctgcatatcgcggtatgcaagctgcaggtccggatctgagaacacatcgtcatcggattttttgtcttttcccgttaataagtaatcagtcgttacttgaaagtaatcagccagcttttggagtgtgtcgtaatcaggttcgcttcgcccattttcatagtgggaatatcgtgcccgtgacacaccgatgtgtgatgcgatttcttcctgtgtccttttccctctgagactcttcaatctgccgcctatcatactatgacctctcttttttaaactccctaagttacttatgattatagatacaatatgtatcaaaataaagttatgataaaaaaagtatcaaaaataacttgatgatacagaacgtatcgtttatacttggtaacagctgatacaaaatgtatcaaaaaaagatcaggagagtgatcacatgtatccgatccaaatcgtttttagtgaaaatcccatagatcagcgccatctcggacaatccggcggcaccatttcgtttaccgcatgcggccttccggtgtttcactttgaaacgcaggaacagtttcaagcatacatgatgttaaaaggagaagcggcgtccaatgaaaaacgataaaagctatccttttccgacgtattcagggttattgaattcagaacattatgacaaaattggcccggcgctatggctgtttctctggtttatcagctcaacaacaaaagaaatcgaaaaagacggcgtaagctggggcatcgtactcggccataagccgttaaaagcgagagaaatggcggcagtcttcggcgtaagtgaaaaaaccgtcagaagatggctggagcttctcgaaaaccatgattacataaaggccgtccgtgcgccatacggactgatgatttcgctcaagcattccaaaaaattcagcttcagatcggacaatactgtacacgggagtctaaaagaacggccattttcgccgcagacaccggacacaaacgaccgtacagatatagataaaacaaacaaatatactgctgctgatgatgcagtggatcacattgcgaagcggtttacacaattacggtcggctcaagaaggacgcaccgtgtatccttcctcaagagattatcaagccatcgcccgcattgttgccatcggcgttcctgtcacgcaaacaatcaaatggcttgaagaatgctttcaggcttttgaaaaccggcggaccgccgcttctgaaacaatcaaggcttttcgctactgctcgaaattcattgaagatcgatttttcgcgcagcaagccaaaaagactgctgcaattcagcatgagaggatgaaaaaacatgacaaaacgaacaatcgaacagattttggacgagctgagaagagggagacgtccattactggcggacaaaccggccgaatcagacgcaagcaggtatgattgcctgcgctgcaaggatcagggaggttatctcgtcaggcagaatggcctggaagtctggacgatgtgcagctgcatagcagaacggaaagtgaagaggctgctgggtgcaagtgagattacccacgctttcagacagctcggcttcaaggaattccgcacggagggaaagccgcaggccataaaagacgcatttgagtgtacaaaagagtatgttgccgattatgaacaaatcaaggattgccgaaaaaacagcattgctcttttaggacagcctggatcagggaaaacacaccttttgactgccgctgccaacgaattaatgagaacatgctatgtgcctgtcatttattttccgtttgtggagggctttactgatctgaaaaatgattttgccctattagaagcgaagctgaaccggatgaagcaggcggatgtgctgttcatagatgacctgtttaaaccggttaacggcaaaccccgcgctacagattggcaattagagcaaatgtattcggtactcaactatcgctacttaaatcataaaccgattttgctttcgagcgagctgacaattgaagcacttgtacgggtcgatgaagcgctcggcacgagaatctatgagatgtgcagtgactatttagtgattatcaaaggagcagcctacgagcttaaccatagattggagggcgtcagataatgtgcaagctttgtcaaacaaagaaagtcattgtggaacataccggtattggagtcgtttttcatccatgtccgaactgccggtccggcactgacttaacgcctgtcattcaaaagctggagcaaatgctgacagcgggaaaagcgaggctgaatatctatgattaaacagctgactgcactaatcgctttgctgtttcgggcaaagcgaacagaaaaaaacattgaacaatggtataaggacgacgggaagtgaaagtgttggcaaagacaaaacaggcagagaaaagccctgcgccgtggcgtgctgtcccgtgcggggatacgaaaccgatctatatttattcagcttacagtgaagaagaaaaagaaagattcccatattcaaacggacggctgattgccgctgtatttgaccttagctcttattcgcaaaaaagcaatgccgctttgatggccgctgcgcctgaattgctggaagcgtctaaagcagcacttgattttctgaaagggaattctgttcattcaaaggagcgcatcattcagctattagaaaaagctgaagcaagcgctgcaccgaaaaggggaggaaataaaacatgattcatcctaaaaaactgctgcatatcgattccgtcacgcttaagagccagctggaggacgggaaaatccgtgtcattattgtggatggcatcaagcaagaagcatggatcacagaagcgcccgagcatggaaaaacgctcgtcgaaacaagaaagggcgaccttgcccgagtggaatttgaaatcggctacaaattaaattaaagcgaaaacagaatacgtccaagacggaaagcctgcggacactgatcaactgcacagcatttgtgcgttgattggtgtccgttttttatttgccaaaaatgaggaggatcatagaatgcaagacttactatttgaatataaacgaacgctcaaacaaacaagaaaccaatataaaccgctcgctgagacagatgaatccgtgctctcagctgaagagctgaaggataaaaaaatcattagaaatatgattactgatcttgaatatgtaacagaatggcttgaaaaaggaaggcagcccggcatcagacgggcgattgaccggcgtgatgcttaccagcggctgatgatcaaggacccgagaatcatcgaatcattttccagcgctatgatgtttgagccggacggacaggtatcagaagaagacagagatagaattcgagaagcattagccctgttaacggacagagaaaaggaaatgtttttgctgcataaggtagaatgtttttcttatgaacggatcgccgatcttctcggcgtgaaaaaatcgacagtgcaaacgacgatcaaacgggcaatcgtaaagatgcaaagacagcaggaagacatgaatcgatcacttgcatgaaagcttgtcatacgtttgccacctataagtgaatagcatgacacataagcggctggctgatcagccgcttttatgaatagacaaccatgctggaggtggcggtgatgccgtagcatgaaaacacaacttcgcgaacaagcattagcaatctatcaacaacatcaaggaaagatcacaaatcgggcgattgcggacacaatcggtgtttccgcgaaaacaatcggcatctggaaaaaacaagacaaatggaaagaggcgctgttttctgcgtccaaaaacgaacaaaaacagcgccctatagacaacgatgaattaaatgaacgccagcggctgttttgcctgtattacgtcaaaagcttcaatgccacacagtcagcaatcaaagcgggctattctcctgacagcgctcatgtgacgggcagccggctcttaaaaaacgaaaaggttgctgctgaaatcagacgcattaaaaaagaaatggtcaatgaaatgtttattgaagcgatggacgtgctgcaggtttatatcaagatcgcgtttgcggatattacggactatgtgaccttcggaaaaaaagaggttcaggctgtcgggaaatcaggtccgctgtttgatgaagatgataacccgattatgaaggaaatcagctttgtcgatgtcaaagactccgggctcgttgatggcaccattgtaacggaagcaaagcttggcaaagaaggcattgccatcaagcttgcagataaaatgaaggcgcttgagaagctatccttatattttgatttgtttccagatcaatttaaacaaaaaatagaaaatgagaaattgaagcttgccaaacaaaaagcggagaaaacagatgacagccaagagccgattgaaattatgatcaaacgaaaagagcgcaagtcatgattgtaaaagaaatcaacccacatttcgaagattacgtgttcaattgggagcagacgtaccagtttcttgtcggcggctacggctcatccaaaagctatcataccgcattgaaaatcgtgctaaagctgctgaaggaaaaacggacggcccttgtgatccgggaggtgttcgatacccatcgggattcgaccttcgccttgtttcaagaggtgatcgaagagctcggtctcacaaaggccgtggcatctctttcttccccgctgcagctgcgatttcacaatggcagccggatcatgttcaaaggaatggacaatccggcaaaattaaaatcggttcataacatttcattaatatggattgaagagtgctcagaggtgaagtatgaggggttcaaggagttaatcggacgtcttcgccatcctgagctaaagcttcatatgatctgtaccaccaatcccgtcggcacctccaattggacgtataggcatttttttcgggatgaacgcaagaaacggtttgtgctggatgacagcgaactttacgaaaagcggacgattgtaaagggagatacgtattaccatcattccaccgctaacgacaatctttttctcccggaaagctatctgaaacagcttgacggactcaaagagtatgatcccgacctgtaccggattgcccgcaaaggacgattcggcgtcaacgggatcagggtgctgccgcagttcgaggtactcccgcatgatcaagtgaaaaaatgtatcgcagccatcagcaagccaatctttcgtacaggcatggattttggattcgaggaatcctataatgccgtcgtccggcttgctgtagatcctgaaaaaaaatacctctacatttattgggagtattatcaaaataaaatgacagatgataggacggctgaggagctgcgtgagtttattgagacacaggaattgatcaaagccgactcggctgagccgaaaagcatccaatatttccgccagcagggctttcggatggttggagccagaaagtttcccggctccaggcttcaatataccaaaaaggtaaaacggttcaaaaaaatcttctgttcggaccgctgtgaaaatgtcatctatgagctcaagacacttacgtatgccaaagataaaaacggagctctgattgaggatgaattcacaattgacccgcatacgctttctgccatttggtatgcgcttgatgattatgaggttgctgatatgaaagagacagcacacaaacgaatccggccgaaccgagaaaggaggaggtcataaatcatgcacaatcaaacagtcagagcaactgtatttaaagccaatgccgccgctcctcagacaaagcaaatctatgaagatgacttttctgagctgtacggagaggacattatcgctccgccctacaatatcatcgagctcaaaaccattgccgaatactcgaccattcttcagcaatgcattgatgcgtacagagtgaatattacaggctttggattcgatgttgagtacacatttgatgtcaacgcaagtgatgtcgatcaggcaaaaaagaaaagagcggaaaaagactgggccagactcgaagccttttataaatgtcttcactttgatgaatcagctgaaatgattttaggctatgccatcgaagacagagaaaaaacaggcaacggatttatggaagtgcttcgcgacggggcgggaaaacctgccggcatcgaatatttagatgtgaaatatatgcgtgtatgcggagctggcgagcctgttgaggtctcatttatatatgaagaaaacgggaaaatgaaaaggatcaaaaggcaaaaacgcttccgaaaatatgtgcagatgattaatggaaagaaagtattttttaaagaatacggcgatccgcgaaaaatggatatgcgtacaggtgaatatgtaaacacattggcagagaagtatcaagcaaatgaagccattcacctcaaaatcggaagcggcgtatacggtgtaccccgctggatcggcaatattgtcaatttatacggagcccgaaaagcagaagagctcaattttatgtattttaagcaggggcgtcacgtccccgctgcgattacagtggaaaacgggatgctgtctgaagcttcttaccgggagctgcaggaatacatgaatgatcttgaaggcgtggaaaacgcccataaatttctcctgatcgaagcggaaggaatcgcaaaagaaaaggatctccacggaggcgaggatattacgccggtttccgtggaaatcaaatccttggcggaaattctccaaaacgacgccttgtttcttgaatacgatgaaaaaagcagaaataagctgcgttccgcgttccgcctcccgccgctgtatacaggcgaggcccaggaatacaaccgggcgacagcggataccgctagaaaaattacggaggagcaggtctttcagccggagcgaaaaacgctcgtgaataaactgaacacgctgcttttgccggagctgaatatccatgacgtcaggctgacattaaaaggaccggactttcgtgatccgcttgagattgcgaaggtgctcggtccctttattacagccggagcagtctcgccgaatgatttacgcgaccttgccggacgggtgcttggcaaaacacttgaggagtggccggaggacatttataaacggcctgcaggacaggatgcggaaaagacaaacctgactgcgctcatgcaggagctgaaagaaagcatcgaagatatcaaaacgtcctgaagggaggtgaatcaagcaggtggcgcgagaattaagaaatgccaaaatcagctttgtcagttatgtggacaaggcggctaaccagacagaatttttctttacgaagtcagccgaacctccgtcatttgaaaaaaaggttcggctgtttacaaaaagtgagcaggatgaacaaaagctcgtgtacggaatcgtgtatgagcctgatgttcctgatgcccacggcgattttatgaccgccgaggaaattgaaaaagcagcgcacggttttctcgcggaggcacgggaaattgatatcaatcacagctttgagggcggaaccggcgtcgtggtcgagtcctatgtggcgcccgatgattttatgatcgggtcaaagcggattacaaagggctcatgggtgctcgtgacaagagcgtctgacgaggtgtgggaacagattaaggctggaatcatcaccggctacagcatggcgggcactgcagatgtgtatgaagaagaaccggtcgaaaaagcagggttcttcagtgtattcaagcaaatgcttgctgacaaaacagggaaggagactgaagaaatgagaaaagaagacatgagagaatcattcgagcatgcgctttaccctctgctcaaacggcttgagcggattgaaaaaaacacagacacggaggaaaagccggagcagacgggtgatgacgagcgtctgaaaaagctcgttgaagacatgcttgccccgctgatcgaacgcatcgaggctttggaaaaagcgcgaggcgcgtctaagcagacagcggacgatacgggcggcaatacagagcaagtcaaaaaatcaatctggagcggactgctgtaaaaccagtcaaggaggaggaaatcaattgagaaatcaagagatcattcggaaagcggaaatgtcgctttctgctttaaaaagcggcgggcttatgaacccttcgcaagcatcggcttttatccgcatggtgcaaaacacgccgaccattttcagtgaatcccgcgtgattcaaatggaaaacgattcgcaaaaatttgaaaaaatcggcttcggccagcgtattctgcgggctgcgcaagaaggaaaagcactgtcaaacgacgagctgacagttccaacgacaagcacggtccaattgaacacgaaggaagtcattgcggaaattaacattacgtatgacacactcgaaaacaatattgaaaaagacggcctgcagcagacgatcatgcagattttagcagagcgcgcagcagttgatattgaagagctgattgtaaacggcgatacagcatcagctgatccgtatctggcgcagctggacggtatccgcaaacaagcggtgtcccacatcgttgacatgaatggtgaagaactgtccagagcgacattcaagaaaggcttaaaggctgttccgccaaaatatttgcgcatccctcaggaattcagattctatacgtcgcacggcttagaagttgaatggaaggaccgcgtggcggaccgccagacaaaccttggggaccaggctgttcagggcggtttgtccacagcattcggcgtgccggtcaaaggggtatccaatattcagccgtacacagtcggtgagggagacgcgcaatatgacgcttctgatatcattctcacacatccgaaaaatatcattctcggcttctcccgcaatatccgaattgaagtcgacaaagacatccgctcccgtaaattcattattgtcttaacggccaagctggacagcaagttcgaggaagaggatgcctgcgcgaaattaattaacgtaaaagaataatagaaacgaggtggtcagctcatgctcattgaaccgactgacgtagcctcctattcggtctatgatcgggtgaaaaacaggccggaagagctgctggcgcaggatatcatcgaggcggaggcagaagcggttctcatcacgggccaccgctttgaagacagcttgtatgatccgctgcccggcaaggtgaagttggctttgcttaagcttgcccagtattttgcgcttgtcaacagcgatgaatctgcctcatcaagctatcagtctgagaaaatgggggattattcctacacggtttccggagaaggcgggattcagcggcctgaggtgtatcatttgctcgaagagtttatcaagccgggctacgtccctgaatcctccagactgaaggtgagatctttatgagctacaagcagatgctcattcaccgttgcgacatttatcatgaagcagcgcaagcgccgtctgcaggccgatttgggattccggcagacaggctgcagccggtgatttcatatccggagacacccgatgaacaagatgtcccttgttattttaccgaaaaaacgcagcagctgattcaggaggagccggatcaaactgtatatcatagctttctcgtccattttccgttgtcagcggacatccgcgtgaacgataaaatcatttgggagaatcataaatatatactaaagctgccgaaaaggatcagacatcatcattgggaggtcatcgcagtcagggatgaaagcttatgaaaatagcgggattgaaacagctgaacacggcattaaaagaagcggcttcaggcggtttttccagacaggcgtcccggtggcttgaggagtgcgggcaagattttctggagatcgtccaatctgaactcatcagcgcacaaacgattgatacagaaaaactgctcagttcctttgagaaaggcgcagaggacaatctctggattgtgcaaagcggcgggctttcgcttgaggtggggacacagcttgattacgcctcatttcttaatgacggccattggacgtcaaaacaagatgtgagatgggtgccggggcgttttcaaggctcacggtttatttatgatccagcggcttcaacgggaatggcgctcaagagaaaatggataccgggcacgagctactgggatcatgcactgcttttatatgaacagctgtttgaaaaatcgctggaaagcaaactgcgccagtggctgaagaagctgtaaaggaggagcaggatgaacagtgaaacaggatcgatcatggcgtttttgtacagccggtggtctgttcccatttatgaacgcgagcttcctgatcactttcaggtgccgtcgttatacgtcccgccaccatctgttttcgaggaaacagatacggtctccacatttaaaaaaacctacagtctcaatgtaaaactgtttcatctggactccgttcaggcgctggatgaagcggacaggctcgcggatgccataagagaagcgagaaatatgattccgctgctgagtgaatccggcgagaagacgggggatatggttcgcatctcccaaatcgagacaagagtaggagacaggggcgaggcggccatggtgatcaggtggagcagccgatattattatcacaaaatagaacagcctgtcttacaggatatcgacatgaacagcggggtgaaataaacggtgtcaaaggacaaacaacagaagaaggctgtacatacaaagagccgggaagctctatttgatacagcggatttgattaagcacgcgaaggaactgttcggcgttaagccggatattcttcaggggctttatttggcgtggatcaaccacgtatgacgaaatcagaagccaaccaattgattcaaacatttctaaccaaggaggtcatgtcatcatgaatggcggaacatttacaacaggcaaagaaaaagaacgtgcaggcatttattttaactttaaaacgacggcacaggagcgggtatcactcagtgaacggggaacagtcgcacttccggtcgcatcaagctggggcgaagcgaaaacgttcgtctccatttccagcgttgaagacctgaacaaaaaagtgggtctcagcattgatgacccgtctttattgctgctgcgtgaagcgaagaaaaatgcgaaaacggtattgatgtaccgtctaaccgaaggtgtccgagcgtctgctgatattgctgaaggcgtcaaagcaactgcagtatatggcggaacaaaaggaaatgacattatcatccgcatcaatcaaaatgtgctggatgctaattctttcgatgtgacaacatatatggacgaatcagaggttgataaacagactgtcaaaaaggctgaagaattaacagctaacggctatgtcacttttaccggaacaggcgatctttcttcaacgattcctctcactggatcagaaggagacactgcagctgagacgctgaatgcatccgcgggaatccgtttatctggcggtacggataaagcccctgtcaactctgactatacagatttcttagccgcggctgaaacggagagctttgatgtgattgcattgcctgttgcagaaggtgaccagttgaaggcgacgtttgctgctttcattaaacgccttcgcgacggccaaggacaaaaagtgcaaggcgtcacagccaattatgctggtgattatgaaggcataatcaacgtaacagagggtgtgctgcttgaagatggcacggaagttacaccggacaaagcaacagcttgggtagctggagcgagtgcaggagcaacctttaaccaatcactcacatttgtagagtacgaaggcgccgttgatgtgttacaccgcctcgaccacgatacgattgttgaacgtctgggcaaaggtgaatttttattcacattcgacgcccgcgataaatccgtcagtgtagaaaaggacattaactcactcgtgacgttcacagctgagaaaaacaagaaatttgcgaaaaacaaaatcgttcgtgtcctggatgctgtgaataatgatttaacacgcgagctgaaagccttaattaaatcaagaaaaggcagcggaagcgatatcccggcatctgaagacggactgcagtatgtaaaaacgatgatcacgcaatacatgacaacacttcaggatgcaggcggcatcactggctttgattccgatgaagatatcacaatttcaatgaatgaagatcgtgacggcttcttgattgacctggctgtacagcctgtcgatgcagcagaaaaattctactttaatgtggaggtaaactaatatggcattaaaagcacaaaacacaatctcaggaaaagaaggccgcttatttctcgatggtgaggaaatggcgcacatcaaaacatttgaagcaaacgttgagaaaaacaaatccgaagtcaacattatgggccgccgcatgacaggccataaaacaacaggggcaaacggaactggaacagcaacgttttataaagtcacatcaaaattcgtgatcctgatgatggactatgtcaaaaaaggcagcgacccatacttcacactccaagccgtgctggatgatcaatcctcaggccggggcacagagcgagtcacgctgtacgacgtcaactttgactctgccaaaatcgcaagccttgatgtcgattcagaagcgttagaggaagaagttccatttacattcgaagacttcgacgtccctgaaaagctgtctgacacgttttaataaaaggcgcatacgcagacctttctcagaaaggtctgtttttttacaggatcaaactaaacaatagacaagggagttttttacatgagcgagaagaacgaaaacgtatatgatctttccttttttatgccgggaaaaacaattgaagctgaggaaatcaaagtgccaatctcaaagcgttttgttgataaaaaagggaacatcgtgccatttatttttaaagcgatcacgacggagcgcattgatgaattggagaaagaaacaacaacgtataaaaatgtcaaaggcagaggccgtgtaaaagatttagacagccaacgcttttatgcccgaatcgcagttgaatcaaccgtttatccggacttccgttcaaaagagcttcgagaagcttacaaaacggctgacccggtagaagttgcgaaacgcgtgctctcagttggaggcgagtatgcgaactggttaaacaaagcgattgagattaatggatttgaagatgaattagaggatctggaagaagaagcaaaaaactaatcaaggatgggcataaagaagccgtgtatctctactatgcgatgcacgagcttcactattccccatcagatttattggcgctctacgaagcgcccagaaactataaagcgctgttgtatggaatgatcggatataagctcgatctccttgaaaaacaagcaaagaaaggaggggcatcgtaattggcaaagctgacagcaaggtttgaaatggaagaccgtgtaagtaaaaagttaagaaagatccagaatgagtttagagcacttgaaaagtatagaaaaatggtgcagcgaaaaagcgctattgatgttcgaaaagaaagcaaaactgtattaaggacaattgatcgcatacaaaaatcattaaagaaaaagcttggcgcccaaatgatctccatttcaactgaggataaagccagcagtgtcattcagcaggttaatgttcaattgcagagattgccgtcatctgtatctataaaaatagatgctagtgaccaagcaaccgaaaagtttgaacgattaagagagctcgtggcaggttttaaaggctttacgattatgctgagtgcagaagatcaagtgttgccggctgtgcaaaaaatacagcgctatatggaaactgcacttaaaaatggttactctgttacgatacgcgtgattgatcacgtcatgaaaacagtcggtcgtatttctgctggtattgatgccttaacaggaaaagacaacaaacttgagctcgctattaatgacagggtgtcaaataagctggattcattgcagaaaagaattgacagcatgggaagctcaggtccctccgagaaaggagcgccttcatcaggaggaaatacaggagatattgcgagcatgtttgatccagaaacgattttgacagcactggacaaatttgctgcttctttcatggaaaaggtggatgaaatcgccacaaagttcagcccggaaacaatcttaacagagctggataaatttacgacatcgttcatgaataaggtggatgaagtcgccacaaagtttagtccagagacaattttgtcgcagctggataagttcacaacatcgttcatgagtaaagtggacgcaattgcaacgaagttcagtccagaaacgattctggcacagttggataagtttacaacatcgttcatgagtaaagtggacggaattgcgacgaaattcagtccagaaacgattttgtcacagctggataaatttacaacatcgttcatgaataaagtggacgcaattgcaacgaagttcagtccagaaacgattctggcacagttggataagtttacaacatcgttcatgagtaaagtggacggaattgcgacgaaattcagtccagaaacgattttgtcacagctggataaattcacaacatcgttcatgagtaaagtggatgcaatcgcaagtaaattcagtccagaaacgattttgtcgcagctggataaattcacaacatcgttcatgagtaaagtggacgcaattgcgacgaaattcagtccagaaacgattttgtcccagctggataaattcacaacatcgttcatgagtaaagtggatgcaatcgcaagtaaattcagtccagaaacgatttttaagcagcttgacaagtttacagattcctttatgaaaaaagtggatgcaaccgcaagtaaattcagtccagaagcgatttttaagcagcttgacaagtttacagattcctttatgaaaaaagtggatgaaatcgcaagcaaattcagtccagaagcgatttttaagcagcttgataagtttacagattccttcatgaaaaaagtggatgatatcgtaagtaaattcagcccggaaacaatctttaacgagcttgacaagtttacagattccttcatgaaaaaagtggacgatgtcgtaagtaaattcagcccggaaacgattttaaacgagcttgacaagtttacagattcctttatgaaaaaagcagatgatgtcgccagcaaattcagtccagacgccattattactaaagcggaagactttgtaacaaatattgttgacaaaattttagagaaatttaatttcctgaacccggataaaatcgctaataaagcagaaaagtttgttgataacattgtttcaaaaatcgccaagaaattcgagaaattcagccctgataaaattattgaaaaagtgggagagttttttgaaaaaattataaaaggcattgctgagaagctggggaatctggatattggcgggttgtttggcggcaaatccagcggaagcaaaggcaaacaaaaagcttcaaaagccaatacaaagaactcaacttctaacaattcaaaccgcactaaaaaaccttctatgaaccaaaaatcttcaggttcaaaatcgaaaaagtcaggcggcaaatggggcggggcttgtggttgctgctgtgccggaatcagtacaggcaaaagcaaaaaagtcaaaaatagaaacggttcatcaacaaaagggaataaaacaaatcctgtgaatacacctaaatctgctaaaggagcagcaggcaaaggtttttcaggccttctgaaaacattgggtgaatcaaaaggcttaaaaggcggactaaagggcttaaaaggagctgcaaaaggaataccgggattaggcgaaatactgtcccttactgacttagccggtatcaataagaataatgctggtgaaaaagtaggttcagccggcggaggtttagcaggagccgctgcaggagcggctattggaagcgttgtgccgggagtcgggactgctattggcggtgttgtaggaggaattgccggtactttcggcggtgaaagtttaggtaaggcaattgatgccggcgctctagaagatacatggaacagcattacagagggtgcgcaaaatgcctggtcagccattcaggatacttggggaactgtatcaacatggtttatggataatgtctggacgccagtgtcaaccgcagttgtgggtgtagcaacaagcatatggtccaacatcgtgaatgcttggacaacgatccaaacgatattcagtactgtatcaacatggtttatggacaatgtctggacgccggtttcatcagcagttgtgggtgtagcaacagcaatatggtctaaaatcgtaaatgcatggacgacaattaaaaatgtgttcagtacagttgcttcatggtttatgagtaatgtgtgggggccagtcaaatcagctgtaataggagcggcaactacaatctgggataaaatgaccggtgcttggaataagattaagagtgttttcagtacggtatcgggatggttcatggatacagtttggaacccggtcaaaaatacagtctcagatgtaggtaagggaatctcagatgctttcaaaaaagcgatagacaccgttaagaacatttggaaaggcctgagcggctggtttaaaaagaatattcaagaacctcttacaaaggtgggagaagcgatttcagatgctttttctaaagcgttcggctgggtgaagcaaatctgggataaagctggcggcgtagctagtaaagtaattaattttgtaaccggcggcggtgatccgaataaaggtaaggatccggataaaaatgccacaggcggctacatcaccaaaccaaccatctcgtggatcggtgaagccggcaaggaattcgttatcccggttgataacaaccgaggccgggggaagatgcttctttcacaagcggcgtctaagctgggtatgcaagttgtagacgacatgggagcagcttcgtcttctggcggaagtccagcatctgtttcaggaggagcagctgtcagtcctctatcaggctcagcctccccagcaatgaacactgcaaatcttacaggccaagcgtccacactcggacagcaattttcagaaggctttggtaaaggcatcagcgatcagccggtcaaaatggaagactggaaaaagaaaaacatcaatacgccatttacacaaatgatttctgcttcaccaaattacggtaaacaaatggtaagcgggtatgccaagggtcaaaacggcactgcaaccggaacggacggctttttgcaatcaaaagttaaaacgccgtaccaagccactgtgaacaaatcgtcttcatggggcacaggaacggtcaaaggctttgcgcaaggacaaaactcaacccaaacagggactgcacagtatgtgagtacacatgttgacaaaccgttcctgcgttcaaaagacacatcgaacagctggggttcaggcatgatcggaaactttgtgacaggcatgaattctaaatccagtgaagtaaaacaagcggcaaaggatatggccaagagagtggagcaggctttccgtgaggaattagatatccattcaccttcccgtgtcatgatgagcttggggcgttttgcttcaattggtgttgtcaaaggccttggctcagtagatgtaaagaaatatgctgaaaaacaagccggatcactggcggctgcctattccggaatgggagccatgggcgggaacgtaaaacagtggattatggccgctctcatggccaccaagacaccaatgagctggcttccgggtctcttgacgattgcgcagcatgaatccggaggcaatccgaacgcaatcaacctgtgggacagcaacgcaaaagcggggcatccgtcacaagggctgatgcagacgatcccaagcacttttaatgaccataaagcaccgggtatgggtaacattaaaaacccgattcacaacgcagctgctgcgatcggctacattaaaagcagatatggatcaatcaacaatgtgccgggtattaaaagcctgaatcatggcggaccgtatgtcggttacgcaaacggcgggctgattacaaaagaacaaattgcccgtgtcggagaaggaaacaagcgggaatggatcattccggaggagcgaggcatccgcggccgctacctccttcagagagctgcgcaagctcttggtatggaagtgacagatccgtctcaatcccagcagtctgagctttcttcaggacaagtttcagcagttacatccggtacacggcaaacgatacaaacagccggaacgaaagaaataaagattgagtttaacggcgatcagcatttccataatggacaggatgctgatggcctggttgcgaaaatcaagcaggcattacttgatgaattacaaaatgacattaacaccggaacaaagggggtcgtggcttttgactaagtctatctatgaattttggatatcacaggggaaagaaaagctgcgattccctgttcttcctgaagcgattgatatagcgaatagtgtacaaaatgactcagtaaagataacgggattgggtgaactaacgtttattgaagaacccggagcaaaagaaatttcattttcttctttttttccaaaaaagtatacgccgatagctgaatatcaaaatctcccgtctccggaaaatgccattgcgaaaattgaaaaatggatgaaggcaaaaaagcctgttcaatttttaattacgggaacaaaaatcaatatgacatgcagtattgaaagccttaaatatagtgagggagacaatgaaataggagatcgggattttgatattgtattaaaagaatacaaaaccgcttccccgcggaaaatcaagcagaagaaaaaaacaaaggcaaaacgtccgtcgaaggctgcgccgaagacgtacacagtgaaaaagggagacacgctatgggacattgcaggcagattttacgggaacagtactcaatggcgcaaaatttggaacgccaataaaacagcaatgatcaaacgaagcaaacggaacatcaggcagccgggccactggatttttcccggccaaaaattaaagataccgcaatgaaacaggtgatgtatgatgatagaactgttcgtcattaaagacacagagtggcttgagctggttgcagaaagcgtatcgcttgaaggccatcgttatcaggcgccgcgctccattgaagcgaccatcgtcaccaaacagggcgaccagacgtattacagtgtctcagaaggagatacggtcttgtttaaatggaagggaaaagagctttttcggggcattgtttttgcaagaaccccggacgagcatacgcttgccttcagcgcttatgacatgcttcaatacctggtcaaaaaccaggatatgtacgtgttttccaatcagcgggccgaccagatcatcagaaggattgctagtgacttccagataccgacaacctcgatcgcaaacacaggccatacgatcaaaagtcttgtcattaaaaatgatacgacattgtatgacatcatattaaaagcgctgaaacagacgaaaagccagacaggacgacattaccagctgtattcggaaaaaggaaagctcggtctgcgcgcttggccagatccgtcagaggtatgggtgcttgaaacgggcgtcaatatcacgggctaccaatacagcacttctataaacgacactgctactcgggtggtgcttcgccggcagaaggacaataagacatataaagcctctgccaaggacagttcaggcttaaataaatacggtgtgcttcaatatacggaaacggtcacagatgacatcaaccaggcacagcttcagcagcgggcagatgtacggcttgctgaaaaaaagggcgtgaaaaaagaactgaaaaatattcaggcagtgggcatcccggaagtgcagagcggcttgcctgtctatatttctattccggaggccggcatcaagaaaacctattgggtagatacggaccggcacgaatttaaaggaacgaaacatacgatgacgatcgatgttgtcgaaaagaatacgatgccggaaggagtttcctgatgagattaagtgaggctataaaacatttggcagtcggcgcagttgacgctgagtctccggtagaactgctcccggctgaagtcgtttcggtttctcctgtggaaatcaaattaaaagaaaacagcaaactgatcataccggaagacgccatcattatcccaaaacgaatgcagtccggaggagacgatgcactcgagccgggggatcgcctcatgaccgcggctctgactggcgggcaatcgttttttattttagataaggtatagacaaaaccgcttcagtacgaaggggtttttatttagcatgtaaaaggagtgggcatcatggccctgacaccagaagtggagtttgaagatattgaagttgagagcgaagtcattgaaacctcgcaaacgtacaaaatagattttgaaaacggaagaattacgaatgagctgattaccgggcttgaagcgatcaggcagttcgtgtatatcgccttacagacagaacgctatgcatattccatatacagccataatgtcggaaacgagcttcaggacgtgctgacagatcatgagacgactgatgcgtataaaaagatggagattccgagactgatagaagaggcgctggtttatgatgaccggatatcggctgtaacagattttgagattgaaaaacaaggcgacgcgtttcatgtgtccttcgtggtggagacggatgaaggaacgcttgagattgaggaggtgattggcgaagatgtttgaagatcagacttttgaagcgattatggagcgtatgctgaacagcatttccgcagatattgacacaagagaaggcagcgtcatttataatgcgttagccccggcggcggccgagcttgcgaagtcttatatatggctggatactgtacttgagctcgttttttctgataccgcacaaggcgaatttttagacaggcgtgcagcggaagcgggaattgaacggacagccgcgacaaaggcggtcagagcgggagagtttacatctggagttactattcctgtcggctcccgcttttacgtggataatctttattttcaatatacggcagacgggacgctcatctgtgaaacacctggtgaagcgggaaacgccaatctgaccggacgcaatttactgtcattggataccattcccggtttagaaacggccattgtcaaagaaatcctgattccggggcgcgaggaagagggagatgacagcttgcgagaacggtattttacaagggttcggcgtgaggccgtcagtgccaataaaatgcattataaagagtgggctgaggaagtggacggtgtgggaaaggcaaagatcttcccgctttggaacggtgaaggcacggtcaaaattgtcgtcaccaatgcgaatcttgagcccgcttctcctattttaattcaaaaagtgaaagattatatcgaccctgaaccaggacagggagagggacaggcgccaatcggagccgttgtcacggtggaaagcgcggtctggaaggaagttgagatttctgccgaagtgctgccggagatcaatcactcaattgatgaagtgaagtcggaaattgaggaaggcgttttaaacctctttaaaaaaatggcgtttgaagacaacgttatccgcctttctcaaattaacaatatcgtctataattcaccatcagtcagtgactactccaatattcaaatcaacggcacgtctgaaaatctggtgctgagcaacgtggaaattcctaagcttgggcaggtgaagatcattgagcaaacaagatgacatgcgagcttatctgccgccgtttctcaccagccttaaagaaatggccgagctgctgaaagcggaagcgcctgagtttgataaacaaaatgacagcatatttgatctgacggatcagttattcgtaccgacggcgacttgggggctcagccgctgggaaaaaattttaaacgtcccgcgggaatcaggcgacactgatgagatcagacgattgcggctcatttccaaaatgtcgaacatcccgccaatcacatacagggccattgagcaggcggtaaaccgtttcttgaaaaacccgtctgcacaggtccgcctgcttcccggcgaataccgatttaacgtcgatatcaatgttgatgacctccagcacatgaatgagctgatcgaagcgatagaaaacatgaaacccgctcatttggcgtatacgctcagaggcggattgaatgagacgctgcaaatcaaagatacagtcatcctgaatcaccgcagataccgaacggccagtgagctcaaggtcggttattctgtcactcttaacaacaatgaggtggttttaacttgatttcaaccatatacagagaacgcacagcggctgatctaaaaagcagaatcgatcacgtgctgctcaacggccaaaaaacagaaatagtagagctcgccattgacggtgcgaccgtcaccgttctgacaaaacgtgaggaagacattaagcatatcgaaacggtacaaatttttgacgagctgggcaacatcatcacagagagaaagactgacctggacgtcagcgaaaacagaacacttgatttcagatttacttttgaggtggtgtaaacatgacatacgaagaaaaaacagactggcttccggacgaccccatcaacgaagatgacgtcaaccgctgggaaaaaggcataaaagacgcccacacagacatggctgcccacaaaaacgacatgaacaacccccacaacacaacaaaggcgcaaatcgggctggggaatgtggataatgtgcagcaggcggcgaagaaggattttgacaagcatgagcaagatcaggtgcggcatgttacagaggaagagcgagagaaatggaatgggggtcagttatcgaagattacaaaagatgatggctcagtctttatcaacatagacaatggacaagattttaacaaagcagctgctgagcaaaggaagtcatttacttttcacacagaaaatacaggagtgaatacacctccacaatcaacgaaaggcatttatttatacttttccgaaaacgacggggaagcgattgctatgacaaatgacgggggaatttggagaaaaacattaacgagcggagtgtggtccgaatgggtatcattcgagacagaagcaggatctaagagtaagtctgaacaggctgaggaaaatgctaaaaattatatagacaaacatattggtaatagcaacattcatatcactaatgatgaacgtgtgaaatggaatggtgctcaactcaaaaaattgaccaaagataatggtagaagaactagggtacctgatgggacagatattctatcattatcaaccggtttttattatgcattaggtaaaaatatagtaaacaacccagttgaaggagataatgcttggtataactatgatgtcatagagggggagagcagcagaaaaacaattgttgcttaccaaagctatgaagtgaccatgtggatcggaatggttcatactgacggtgagttcagaggatggaagcggctgattacttcagaagaattaaaaagtgaaaatatcaataaaattgctgatgagtcactgtatcaagatgcagcatattcaggtaacaattatccaatcggtattaccaccgtcagtattctccaagggtctacaggttatccctatgaatttggtgaagtgctgaatataaaatcgagcatatatcgatttgcacagtttttcttttatgccggaaacgcaggtcaaaagaaaatatttattcgtcactggtatgatagcacaggctggactgagtttattacgatcccttcatcagatgaactagaaactgttttaaatacagcaaagctttatacggacagtcatgctaataacacggaaatccatgtcacgcagaacgataaaactaagtggaataacagtcagattttcaaattgactcaagatgatggaacgttgggaaaattctacaatgaagatttaaataatataattaaaacaggattttattatatttattcttctacgactgaattaaatgctcctattaatagaaatgggtatttgcttgtatataatgttggtacctatccgtatcaagaatttactacttattcgggagaaacagcttctattccagacaatagaagaaaatttatccgaaataaaaagcaagattcagaagaatggactccgtggatggagattgaaaattcacaaggagcacaggcaaaagcagacaaagctttagctgatgctaaaacctatgtagatacaaattatacaaatcaaaaattaaccaaactttcaggctctgatgcaataacagatgctagaactggaggggatgagtatcctcagggattaactttaatagatattggtcaaggaaataataccggttacccgcttcgttacggcttcgtgaaaaatgagaaacacagtgattttagatttgttcaatatttttatggcactggaaatgaatctggcagttacattgatagtactggtacatggataaggcattggtggagtgggtcaggctggacagcttggcataaaatttctggatttgctcatgcaaatataggaactacaggcatacagtatttggataaaaaagcccacacaaaaattcaatttaaccgcaaaagaaaagatagtcacaatgcatttgatacaaaaaatagtagattcgttgctcctaatgatggaatgtttttagtaggagtggggctgtatatgataaatacaccggcttacatcaattttcatctgaaactctatctaaatggatcattgtataaaccaattgaccataagagaggggactttgttgataagcaaaatgaaatgtaccttggattaaatggtaatgtaaccgttcctatgaacaaaggtgactatatagagatctattgttattgcaattatagcggtgatgatagaagaggtgtatccgattttaacgaactatacaactatatagacgtccaagaacttggaggacttaactatcctacagtataagataggaggcaaaatgatgatcgcagaagcaatcatgtttaaataccccagtgcagacccaacaagagattttatcgttcagaatgacggggaagggtcttatatagctgaatggaatctgcgctcgcccatcccaacacaaaaagaactcgaaacctggtgggaagagctgcaaaaaaatccgccgtacgagccgcctgatcaggtggagcttctcgctcaagaattgtcacaagaaaagctggcacgcaagcagcttgaagagctgaacaaaactttgggaagcgagttgtcagatataaagctatcattactttccttgaaaggagatcttgccgaatgaattattgggtgctagccctttattatgagtgggcgacagcagatatggtaaaacaagcattagcatataaagactgttcaattgaggagctggcagagggtgtgaacaaaaagctgatcacagctgaccagtataaagaaattaccggtaaagccatgtaaggcttttttattttgcctgtttttagatcaaaggaggatgaagatggtgaagtatcaatatgaatttcctctcgataaggctggaaaagccggcgctgtaaagccctatcgaggaggaaaaaatgattttgtgacacctgtttcgaatttgtcaggcgtagcggagattttaacaaatgctgctttaaaggcgactgaggcatacagtcagctcgggcaggacaggcttggcgcagttctgatttcgaaagtgaagggctgggcgtatgcagatcgtgaaggtacgctctttatagaagaaagcgacaacaacaatgtttggacaacgacagcagcagttaatgtcgcagcaggcgtcctgacagcgacggactgggtatatctttctaaacgctattaccgtttccgctatgtgaacgggaatcttcagcaatctgagtttgtattataccaatcagtcggtgcgggtgagatggatgtgcgtgtcaatgaaaaaacgcctttacagattgactttgcggagaatcaaacacacgatggacggctgaaagtcgaggctcgcaaaacatttgactttgtctttcatgaaaatgcagagtccgccggcgagggggctgctttacctgttgacggtgccgcgcatttactcgttgaagtctacggcacagcagaaatgagcgaagtcaaattttggggcaaatcggtgtcaggacagaaactgccgatcagaggcgtgaaaactgatgatgctaccactgcctccagtacattaggaaaagctgaggcatgggcctttgatattaaagggtttaaggagatcatcatggagattatcagtatcaccggcggtactctttcggtaaaagggaccgcggtttcataatagtctcggccctcggaagggaggtgatctgcatgtgaaggaggagtgagagatgcagcaagaggcagacgtgaatgtgtttcagcaggatttagcagacatgaaaggcgagcacaaagcacttgagcagagggtttccgcattagaacgcgtgtctgaccggcaagaccagcaaatcatgacgctgaacgaaaaattaaacaaaattgaagaaaacaccacgtggattaaacgcaccatcacaggtgccatcattacagcagtgtctacaggcatcattggcggagccatcgccattatgtacagcctgctgcagcattaaagggggatttttatgaacacgtttgacaagggcacggtcatcaggacggtgcttcttttaattgctttaatcaaccagaccatgctgatgctcggcaaatcaccattggacattcaggaggagcaggtcaatcagctcgctgacgctctttattcagccggttccatcgcatttacaattggaacgacacttgccgcttggtttaaaaacaactatgtaacagaaaaagggaaaaaacagcgcgacttgttaagggacaataatctgacgaaataaggagagatgaaaatggttaacattattcaagactttattccggttggcgcaaataaccgtccaggctacgcaatgacgccgctttacattacggtgcacaatacagcgaatactgcagtaggagcggatgctgcggcccatgcccgctatttgaaaaatcctgatacgacgacaagctggcattttacagttgatgatacagaaatttatcagcatctgcctttgaatgaaaacggctggcatgcgggagacggaaatggcagcggcaaccgggcttctatcggaattgaaatttgcgaaaatgctgatggagattttgcaaaagcaacagcaaatgcccagtggctcatcaaaacattaatggctgaacataatatcagtctcgccaatgtcgtccctcataagtattggtcagggaaggaatgtccgcgaaaattattagatacgtgggattcgttcaaagcaggaattgggggaggcggcagccaaacttacgtcgtgaaacagggcgacacacttacatccatagcgagagcatttggtgttacggttgctcagctgcaagagtggaacaatatcgaagacccgaatcttattcgcgttggtcaagtattaattgtaagtgctccatcgtccgctgaagaacccgagctctatccgctccctgatggtatcattcaattgacaacaccttatacctcaggagaacacgtctttcaggtgcaacgagcacttgcggctctgtatttttaccctgataaaggcgctgttaacaacggaattgacggcgtttacggaccgaaaacagctgacgcagttgcccgttttcagtctgttaacggtttaactgctgacggtatctacgggcctccgacgaaagcgaagatcgcagcgcaattaagctgatcaaagaccataaaaatcccggagccgctccgggatttattttttcttcttcaactttttaataattccagcactgcgctccctcacccgaagcgagtacccggaaagcccaaaccttccgtaatcaacaaacttcacacgcctcaccaattttttcactgtatcacctgacattatcctctgtttgtatttattatatgtaatcctttaagaaaaggaataaggacaagagctttttcccttgtccttttagtgtgatcatgctttttttcgtttatactcgtcaatcagccgttcgttttctttgaagattcttgctgtatgcggactgacttgatagcttgcgacactggtggttgaacgttttttcaggattttaaacggcttcgccgctctgggctcgcatctgttttgaaacgcacgttccattatccttcaccttcctcctcaattggcagcaccaaatcatatatgctcgttaatgacgtaaatagcaaataatcaaattccgtgacaatgctgtcagacgtcagcttgatgacatagttctgtgtctcgatggtaaaagggatgagaaccacttttccgtattggtcgtaataaacatcctttcgatcgagccgtgtttgtacatctgccggatcatccatatgctcggttaaccggtctttatcagcctgtgtcgaatagtggcaaagagaagccgttaagttcattttatcagcataggttttcagcagcttatcaataccttcagcataagcatctatacttccataataaacatggatcggttcgtttttcaataggtattggtatgttttcagccgattgagatacatgtggagcatttcgttgttttcttcaagaatttctcttgtgtctgtttcaagctcgctgccggccagttttttgacgtatgcacttaagaagataaaagcatcaatcaaagcaaaactgactgcgacaatgagataccgttcccagtgggtaaatagggaagtgggctcatatgtccagtataccatagcacccagaacaaacagcaaataccaagttttccggatggcggacattttttctttgaccttcgcttcgaaacgccacgtggcatacacgtataaccccagtccggccacgatgcaccagaccatgatctgaaagaataaaaccatattcgaatccctcacatctgaaataggttctgcttattgtattcgagagatccggatggttttcctgttccatcaaaaaaaccgctcctttgacagaagcggtgtgacattaaaatatcatatttaaaataaagtaggcgatggcaccaagtgtcgctgaaatcggaagcgtgatgacccatgtaatgagcattcgcttggccgtaccccagtttacgccttttacccggtgtgacgcaccgacgccaagaattgatgaagaaatgacgtgggttgtactgaccggcaaatgaataaatgtggcgccgaaaataatggctgctccggttaagtcagcggaaacaccgtttaccgggcggattttcatgatctttccgccaacggttttgatgattttccagccgccgattgatgttccgagacccatggctgtcgcgcaggcgaattgcacccaggtaggaatatcattagcagaagtatgtaaattcgctgtgatgagagccattgtgataattcccattgctttttgcgcatcgtttgttccgtgtgtatacgattgcagggcagctgttacaatctgcactctgcggaattgcttattcgttttcgccaagttgctgtctttgaaaatcagcttaacgatgctataaagaataaaaccaaggacaaaggcaataattggtgatagaatcagtgcttcaatgattttaatgaagcccttatagtttaacgctgcaaatccggctgccgcaatggctgcaccggcaatagcgccgatgatggcatgggatgagctgcttgggataccgtagtaccatgtgataaggttccaggcaattgcagcgagtagcgcagccaaaatgacaacagagccattttccagcgtataaggatctacgatgtctttcgtaatggttttggcaacacctgtaaacgtcattgctccgacaaagttcatcacagcagccaatataatggcatggcgtggttttaacgcttttgttgataccgaagtcgcaattgcgtttgccgtatcatgaaacccgttgatgaaatcaaacgccagagcacaaatgactattagtatcgttaatattaatagaatatccatttttacccctcgttacgcgtttttcataatgatggtttcaagattattggcaacactttgacaagagtcggcgatttcttcaagcgtttcgtatatttcacgatattgaatgactttgattggatctgtttcatttccgaaaagattctttaatgattttctgtgcaagttgtcacaactgtgctcatattctttaattttgattgcgtgaggctgaatatcttttaagcgattttctgccagcagctcgatcgtaatcaaaatctctttcgcacattctctgatatatccgctgaatttatcaatatgctcgtctgatgaagtaattgagaaaatctccatcatggcagagaaatgttcgattccgtcaagcacatcatccaagctgtttgtcagctgaaggatatcttcgcgctcaataggagtgatgaacgctttgttaagctctttaatcatgacatgaacatgattgtcaccttttgtttcatattcctttaacgtatctgcaaattctttaagagtcgtttggttagtgaccttaaaattcacaaaatattctgcagtttcgtctatgttctttgcaatttctgttaaaaggagtgagaacttatctttttttcttcttatcattaaaaaccctccatagtttgaatgaacaatgcacacatcaaattattatatagccttttgtcgaaaaaaaacaggtaaagtcgaaaaaaacgtatcttgacttttttgataaatcgtgtctccttattttgacctacttcgctttaaaaaaacgacccaagtttgcaaaaactttctgcttaacgtaaaaagtatatcaaaagttgtgtttttcctgtcaacttttatcttctgtttcaccaaaaaacggttccctaaacaagggaaccgttttatcagcttgcttttcgttttttcatcccgtaatagacaggcagtccggcaaggccgatgaggatggataatccgcagctcattgtatctgtaatgagtgtgctgcctaacacaaagaaggagcccgcgattgccagaattggcataaatggataaagcggaacactgtaggcgcgcttttctccctttgctcgcttgcggagaataaacactgcaaaaaaggccatcacataaaaaatgtagatcatgaaaatggagatttctgagagcttatcagggttgctgatcagcatcataatcaaagccaaagcaatttgaaaagaaatcgcaatccatggtgtgcggaacgacgggtgtacatgtgacagtttttcagcaaatggaagctgtttgcgttccgccattgcaaatgaaacacgcgggaaagaaagcacctttccatttaagcacccaaagatgctgacgataatccctacactgatcagctttccgccaattgaaccgaacagcatggttgcagcggtgcttgtcgcattttcaccaagcgtgacaatttcgttcgctgacaggatgtgaagcaatgcaaaattaatgaaaatatagatcgccgttacaattaataatccgcccgtcatagcgcgtggcagcagcttttcgggatttttcatttctccgccgagagcggcaaggagaatccatccgtcataagcaaacaacgtagctaaaatagccgccccgaagttcatatcagaaatgctttcgtttactgctgtgaagatgtgctgatcgcctttccaaaggccaaagatgatgatgcaggcaatcggaatcagttttccgatcgttgtcagcgtttggacaaaaccgccgtattttgtaccgataatattaatgacgcataaaaagagaactgctataattccaatgacttttgatagtccagatccccagccgaaaagattcgccattaaagatccaaaatataaacccagcgcgccgataatcgccgggccgtaaatgataatctgcacccagccgcacaaaaatccccaaaactcgccgtacacttcttcaaggtacgtataaagcccgccggtttttggaatctgcgttccgatttccgcgattgtcaaaccgcccgccagtgttaaaataccgcctaacagccaggcgaaaagcgccgtttttgaatcacctgaataagcaagcacagcgccgggcttcataaaaacaccagaaccgataatggttccgatgacaagagtaagggcaaacaagaggcctatctcttttttcaaaccgttgtcttcagtatgcatgtccttaacctcctatgatgttgaagcttcatgttgaagaatctattttttcatattgtaaaccctattttagaaaagtgaaataaaataaattttctgattttcgaaatttgctttgtgtacagcaaataaaactgtaaaaacgcctgttttaacaatctataaacgaataaacttcgtgatttttatttataaagttcgtgttttatgtattaggattttagccggtacagaggggaggtgagaattcagaaaatgaacgaaccttcggtgaagctgatatgttgactttctcatgcgaataaaatactttgttattagaacaataaatatacaattatgatatgatatctcgaaatcgagataaaataacctggagggacacatatgaaagttaacggcattcaccacgtatcggcattaacggccgacgcacaaaaaaacttggatttctataagaaagtattaggattaaagctcgtgaaaaaatccgtcaatcaggatgaaccgacaatgtaccatctgttctacggagatgaagtggcaaacccgggaactgagctgacgtttttcgagattccccgcattgcaccgtttcatgcgggaacaaacagtatttcttctattggattgcgcgttccaagcacagaagccctgcattactggaaagaacgttttgaagagcagcaagtaacgcacagcggtatatccaaaagagctggacgtgacatattggcatttcaagatcatgaagggcagcgacttgtgctgactgctgatgaggaaggaaaaggatatggcctgcctgttaaacagagcggcattccggaagaattttcgtttcgcgggttagggccgattgaactgactgtgccatatgctgaaccaaccttacacgtattaacgaatattcttggatttacagaaatcagccgtgaaccagtcgaagggcaaggaaccgccgttattctggaatcaggagaaggcggtgctgcaacggaaatccatttaatagaaagaaacgatcttccgcgcgagcgtcaaggcaaaggaagtgttcaccacgtcgcatttcgggtaagagatgaagaagaacttgccgggtggcaccggatcattagccgggaaggctttagcaattccggcattgtggagcgctactatttcaaggcgctgtatttcagagaaccgaacggcattttgttcgagttatcaacagacggaccgggctttatggtagatgagaatcttgatgagcttggccaaacgatcgctcttccgccgtatcttgagcatcgaagagctgaaattgaagcgaaattgaaaccgatccaataaattgtgattcatttgccttccggcgcggccggagggctttttttattaccataattaattttgacctaaacagcatgccttattagggaggaaatatcagatgctgattgggagaaatggcttgaaaccctttgcaaatatgggtgattggtatggaatggcctcggcaaaaatattgtctttgtttattaatagtttattcatatttgcttgttacactatttccaagttagacaaaaaggagtgaaaaataagtggaaaagaaaaaacgcgagctggatattttcctcatcctcattttgctcgcatctgcattcttaaatatctataacatctggaatgatgatacggtgaatccttattacaccgctgcagtcacaagtatgatgcaaagctttcataattttttctatgcctcattcgacgcggcgggtttataacggttgataaaccgcccattacgttccagatacaaaccatcagcgcacttatattcggtatgcacggctggagcgtcatcctgcctcaggcacttgctggtgtaggttctgtccttttaatgtatctgttaataaaaccgacattcggtaagacagcagcaagaattgcctctttcatcatggcatgtacaccgattgctgtagctgtagcacgtacaaacaatgttgatgcattactggtatttttcttattgcttgctacatggcttctctttaaagcgatcagaaaaggaaagctgatctggctgttagcagcatttttcgttgttggagtaggtttcaatacaaaaatgctgcaggcttacatgattttaccggctttcttattgttctatctgattgcggcaaacgccacaatcaagaaaaaaatcgtttcattggtaagtgcgttagccgtattagcagccgtttcgttatcgtggccgctcattgtcgacaatatccctgcaagcaagcggccttatatcggaagcagccaaaccaactctgttttggaattggctttcggctataacggaatccagcggctgacaggccaaaattcaggcggcggccagggtgcgccaaacaaagacgcttcaaaagaaatgtcttcttctgataacactcaagcaccgcctaatcagtcatcaagcagcagctcatcaaatgatgacaaatcttcaaatggcaatatggcggcgcctccatccaatggccaaatgccaagcggcggtcaaggaggccctccaagcggcggagatggcggccaaggcggacctggcggagacggagggaaaggcggtacaggaaccggttcgaaaatgcaatcaggttcagggatgtttggaacgggaacacctggtccactgcggcttttccaaacagagttatctgatcaaatcagctggcttctgccatttgcgatatttggaatcgcaggcttactgatcgcaggcgcgagagaaagaagaagattatctatagagcagaaggaaacggtgttctgggttgcgtggcttgtaccgattgccggattcttcagtgtcgcagaatttttccatcattattatctcatcatgctggcaccgccgattgcggctcttgtcggtgcggggtgggttgctcttgttcatctgtaccgcaatcagacaggctggaaagcatggcttctgccgggagcaattattgcgacaactggatttgaattgtttattctcagaaactacaacgatcaaatcggtgttggatggagtatcggggtaggtgttatcggcgcgttgtcagcgattgctttgctgctgtttaaacagcgccaaaaaccgttcagttattatgtttcacttgcagctctcctcgcattgctggtgatgccgatttattgggcaagtacgccacttctgtacggaggcaacagctcactgcctgaaacaggccctcagctcgcatcaatgagcggaaaaggcatgggaatgtctgatgcgactgtaaatgaaaaactgatcaaatatctagaggagaataactccggagctgaatacctattcgccacaaccgattcgaacacagcggcaccatatatcattaaaacgaaaaaagctgtcatggctattggcggatacagcggttctgacccggcaatcacactgactcaattcaaaaaacttgtaaaagaaggaaaagtgaaatacttcttggcttctggaatgggaagaggcggaaacaatgacattgttgaatgggttgagaaaaatggaaaagaagtagcatcagaaaaatggcaatcaagttctgatcaaaaaacaggaaatactgattcgactgatacatcaagcagcaaggcttcaggtgaaaacggcaaaatgggcggacctggcggaatgaatcagtcagcaacattatacgaactacatgctgatgaataggaggcaaaaacatgagcagacatattcaatattcaattgttgtacctgtgtataacgaagagcttgtcattcatgaaacctatcagcgcttaaaagaggtcatggatcaaacgaaggaaaactacgagctgctttttgtcaacgatggcagcaaagaccgcagtattgagattttaagagagcacagcctgatcgatccgagagtgaaaattattgatttttcaaggaattttggacaccagatcgccattacggcgggtatggattatgcacaggggaatgcaatcgtcgtcattgacgccgatttgcaggaccctcctgaactgattttagatatgattgaaaagtggaaggaaggctatgaggtcgtgtacgccgtgcggactaaacgaaaaggggaaacctttttcaaaaaacaaaccgcggctatgttttaccggcttctcagcggtatgacagatattgatatcccgattgatacgggggattttcgtctcatggacagaaaagtctgtgatgaaatgaagagattaaaagaaaaaaatccatttgtcagagggctagtcagctgggtgggctttaaacagacagcggtcgagtatgtacgtgatgaaaggcttgccggagaaacaaagtacccgctcaagaaaatgctgaagctgtcaatggacggcatcacgacattttcacataaaccgctgaagctggcaagctatgcggggattttaatgtcaggtgctggatttctgtatatgtttatcgtgctgtatctgaagctattcacagacagcacgattaccggctggtcatcacttattgtgatccagctcctgttcagcggcattgtccttctgattttgggcgtgatcggcgaatatatcggcagaatctacgatgaagccaaagacaggccgctttacatcgtccaaaaatcgtatggaattgaaaataaaagactctatagagaccagcatatgtcataacctcaaaccccctgtccgtaatggacagggggtttttatgctctgagcacgatctaaagcaaaagatgctgatagatatatggaaattgggtaaagaagagattgtgagcttgtactgcggttcagtcatgctgaaataaaaacagaaaaacttaaagatttcgtcctcggctttgctgcatgtcagctgttatattggagggcttttaagaaacgcatgattagagccgtaccagttatgtttaatagaatactggtacccaatacaattccccacgtcaacgtcgattcagagagaagaaagctcagcaaaagaaaagccaatcctgcgcagatcatacccagtccccacggtttgcatgttcatgcctcctagcaaacgatgtttctagcatctgatgtgaatgatgtcaatctgtatgatatacggatatctcgtcagaaagtttcatagaacaattaggtcttttatctaataaaaagcctcagaccgcttttacggcctgaggcattatgtcttacgaagttttctcttctttttgatccagtttaatttttttcgtcatttctttgccgtttcggagaattttcacttcaacggtatcaccgatctttgcgtctttatataagatattgcgcaattcactgcctgtatcaatttctttaccttttaggccgatgataatatcctccgcttttaatccggccttttcagcaggagagcctgaagcgacctcacggatgtaaacacctttattcagctggctgccgaacaggccgagtgtgccttcttggtaattttgcggcacttgctctagatcaagcatgctgacaccgatatatggacgttcaatttgtcctttagacagcaattcttcagcaatcggttttacgtcattgcttggaatggcgaatccgataccctcaacatcatcctcactgattttcatactgttaatgccgacaattttgccgtctgtatttaacaaaggaccgccgctgttacctggattaattgctgcgtctgtctgaatgacgttaatgctcgtttcgccggctgatgtagacattgaaaccgttctgtccacgccgcttacaattccttgtgttactgtgcgggacagatcttttccaagcggatccccaatcgcaataacggtctcgcctgttctgagatcagatgaatcaccgaagtttgccacttttgtgacgtggtcatcactgatttggaggacggctaaatcagttaacgagtcactgcctaccagctttgcagtaacctcagtgccgtcatataaagataccttcagtgatgatgccccttctacgacgtggttatttgtaatgatataagccttgccattctcttttttgaaaatgacacctgaccctgaaccgctttctgtatcttcgctggaatcagaagaactagagccgaacaaagagctgtttgattgtgcctgaagatttgtaataccgacaatcgctggtgaaaggtcttctaccatatctgagattttagaagagtcctcgctcttgaatgcagatgagctgcttgagcttgatgagctttttttagattcagaggaggtgcttgttgctgtaacagattgcgtttgctgctggctggatgattgttttgcagtgtcctgagaatcatggtcgccaagcggtgtaaacgtgtaaatgccaagggcgagactgccgccgatcactccgccaagcaacggtctgaaccatccgaatcctcgttttttcttctcctgatcatgaatgacattgcgggccgagtaggaggcgctctgattgttctctttcgttaaaaagacctcattctcattacctttcgttctgttttcatcacgatagttatccatcatgttcactccgtttctctattttcacatgtctatttatattgataggtttatgacttgagtttatcataaacaaaaactgtgggataaaaatgaaaagattatgggaaattgtgaaaaagtgcggaaaacggtacacttcatattgtatatgaaaggactgagtcgatggaacagattggattgattggatatggcagcatggcggatatgatcgccagacagctgttgaaacatgaacaaataaaagagaatgagctatttattgagacgagaacgaagggggagcggctgcgggcactcatgtcagattatccaaacgtatcggctgatccgttggagaattgggcaaatacgtgccaattgattttgatatgcgtcccgccgctccatgtcatcgaaacaatgcgccgtctgcacccatatgtgaacagaaatactcacatcgtatccatagctgccggtgtgccgctgcgtcttttggaggcagaaacagaagccggtgtatcacgtgttattcctgccattacgtccgaagcagaagctggcatctcacttgtcgttcacagtgaagcactggctgcggagaagaaagagcatctgaatgaattgttatcggttttcagccgtgttcgagaaattaaagaatcgaatgttgatgcggccagcaatttaacgagctcggcaccgggattcatagctgcaatctttgaagagctggcactgtctgccgtcagaaacagcagcctgtccaaagaagaagcctttgattttctgattcattcgctatacggaactggcaaggtgctgatcgaaaaaaatatgtctttcgaggagacgctggaacgtgtcgcaaccaaaggcggaataacgggagagggagctgaggtgatacgcgcctctgtgccggacgtttttgatgaggtgtttgaaagaaccctgaaaaaatatgaactgcttacagaacaggttggtaaacagacatgaatccttgaaagaggattctttttttatcactgaatgattgagatttttcccagttatattgcatttttcctctttttttaatataatctgttagaatattcataatttagtaaaaaaggaggagcgttatgaaattgtacatgtcagtagatatggaaggtatttcgggtcttccggacgatacctttgtggattccggcaagcggaattatgaacgcggacggcttatcatgactgaagaagcaaactactgtattgctgaagcgtttaacagcgggtgtaccgaggtgctggtcaatgacagtcattcgaagatgaataatctgatggttgaaaagcttcaccctgaagcagacttgatttctggtgacgtcaaaccattttcaatggtggagggactggatgatacgtttacaggcgctttgtttctcggttatcatgcgagagcctcgactcctggtgtcatgtcacacagcatgattttcggcgtccgtcatttttacataaacgatcggcctgtcggtgagcttggattaaatgcatacgttgccggttattatgatgtcccggtattaatggtagccggggatgaccgggcggcgaaggaagcagaagagcttatcccgaacgtgacgacagccgcagtcaaacaaaccatttcaagatccgcagtgaagtgcttgtcgcctgcgaaagccggacggctgttgacagaaaaaaccgcatttgccctgcaaaacaaggacaaagtcaagccgctcacaccgcctgacaggccagttctgagcattgaattcgccaattatggccaagcagaatgggcgaatctgatgccgggaacggaaatcaagacgggaactacaaccgttcaatttcaggcgaaggacatgcttgaagcctatcaggcgatgcttgtcatgactgagcttgcgatgcggacatcattctgctaaaggggtgttttaggctttggcgcgatacatgataaagcgtttttgggcaatggcagctacgattttggtgattaccaccctgacttttgttctcatgaaggtcattcccggatctccttttaacgaggagagaggcacaaatgaagccgttcaaaaaaatctcgaagcctactatcacttagacgatcctctcattttccaatacattttctacttaaaatccatcattacattcgatttcggaccttcaattaaaaaaccgtcggacagcgtaaatgatatgctggaacgcggatttcccgtttcctttgagcttgggatgacagcgattgtcattgctgtgatttctgggctggtgctgggcgtaatcgctgcactccgccgcaatgggtttttggactacgccgcgatgagtcttgcagtactcggcatctccatcccgaattttattctggcaacattgctcattcagcaatttgctgtcaatctcaaactatttcccgctgcgacatggacgagtccgattcatatggtgcttccgaccgcagcgcttgctgtagggccaatggcgatcattgccaggctgacacggtcgagcatggtcgaagttctgacacaggattatatccgcacagcaaaagcaaaagggctttctccgttcaaaattatcgtaaaacacgcactcagaaatgcactcatgcccgtcattaccgtcctgggcacactcgtcgccagcatcttaacaggaagctttgtcattgaaaaaatctttgccattccgggaatgggaaaatattttgttgaaagcattaatcagcgggactaccccgtgattatgggaacgaccgttttttacagcgtcattctgattatcatgctgtttttggtcgatttggcctacggtctcttagacccgcgcattaaactgcataagaaagggtgaagcgtgtgaatctccctgtacaaacggatgaacgccagccagaacagcacaatcaggtgcctgatgagtggtttgtctcgaatcaggaaaaaaatcgggaagccgattcggtcaagcggccgagtttgtcatacacgcaggatgcctggaggaggctgaaaaaaaataaattagcgatggccggactctttattcttttatttctttttgtcatggcagttatcgggccctttttatcgccccatagtgtcgtacgccaatcgctgacagaacaaaatcttccgccctcagccgatcattggttcggcaccgatgaactcggccgggatgtgtttacccgaacatggtatggcgcgagaatctcgttgtttgtcggcgtgatggcagcactgattgattttttgatcggtgtcatttacggaggcgttgccggctataaaggcggcaggattgacagcattatgatgcggattatcgaagtgctgtacgggctgccgtacctgcttgttgtcattttgctgatggtgctcatggggccgggactgggcactattattgtggcgcttactgtgaccgggtgggtcggcatggcgagaattgtaagaggccaggtgcttcagattaaaaattatgaatatgtactcgcctcgaaaacctttggcgcgaaaacctttcgcatcatccggaagaatttgctgccgaatactatgggagcgatcatcgtacaaatgacattaaccgtacctgccgccatattcgcagaatcatttttaagctttctcggcctcggcatacaggctccgtttgcaagttggggcgtgatggcgaatgacggcctgcctacgattttatctgggcattggtggcgcctgttttttccggcctttttcatatctctgacgatgtacgcgtttaatgtgctgggggacggattgcaggatgcgcttgaccctaagctgaggaggtagctgtatgaaaaaagttctgtcagtccaaaatctgcacgtgtcttttacgacttacggcgggacggttcaggcggtcagaggggtgagctttgatttgtataaaggagaaacctttgcgatcgtcggcgaatccggctgcggcaaaagcgttacctcccaaagcatcatgggcctgcttccgccttattcggcgaaggtgacagacggcagcattctatttaaaaacaaagacctttgccgtctctctgacaaagaaatgagaggtataaggggagccgacatttctatgatttttcaagacccgatgacggcgttaaaccctacgctgactgtcggcgaccagctgggggaagcgctattgcgccacaaaaaaatgagcaaaaaagcggcacggaaagaggtgctttccatgctgtcattggttggtattccagatcccgaagagcgcctaaagcaatatccccaccaattcagcggcggtatgagacagcggattgtcattgcgatggcgctgatttgcgagcctgatatcttaattgcggatgaaccgaccaccgccctggatgtaaccattcaggcacagattttagagctgtttaaagagattcagagaaaaacgaatgtgtctgtcattctgattacgcacgatttaggggttgttgcccaggtagctgacagagtcgcagtcatgtatgccgggaaaatggcggaaatcggcacaagaaaagatattttttatcagccgcagcacccatatacaaaaggcctgctgggctctgtcccgcggctggatttagatggcgctgagctgaccccgattgacggaacgccgccggatttattttcgcctccgccgggctgcccgtttgccgctcggtgtccgaacaggatggttgtgtgtgacagggtgtacccgggccagacgatcagatctgactcgcacaccgtcaactgctggctgcaggatcaacgagcagagcatgcggtgctgtcaggagatgcgaaggattgaacatgaaaagggggaagaggatgaaacgagtgaaaaagctatggggcatgggtcttgcattaggactttcgtttgcgctgatggggtgcacagctaatgaacaggccggaaaagaaggcagtcatgataaggcaaaaaccagcggagaaaaggtgctgtatgtaaataatgaaaatgaaccgacttcattcgatccgccgatcggctttaataatgtgtcatggcagccgttaaataacatcatggaggggctgacgcgtcttggcaaagatcatgagcccgagccggcaatggcggagaaatggtctatttcgaaagataataaaacttacacatttacgattcgggaaaatgcgaaatggacaaacggagatcctgtaacagccggagacttcgaatacgcgtggaagcggatgcttgatccgaaaaaaggcgcttcatcggcattcctaggttattttattgaaggcggcgaagcatataacagcgggaaagggaaaaaagacgatgtgaaggtgacggcaaaggatgatcgaacccttgaagttacactggaagcaccgcaaaaatatttcctgagcgttgtgtccaatcccgcgtattttccggtaaatgaaaaggtcgataaagacaatccaaagtggtttgctgaggcagatacatttgtcggaaacggcccgtttaagctgacggaatggaagcatgatgacagcatcacaatggagaaaagcgacacgtattgggataaagatacagtgaagcttgataaggtgaaatgggcgatggtcagtgacagaaatacagattaccagatgtttcaatcaggggaacttgataccgcttatgtccctgctgagctgagtgatcagctgcttgatcaggataacgtcaatattgttgaccaggcgggtctctatttctatcgatttaatgtcaccatgaagccgtttcaaaatgaaaacatcagaaaagcctttgcgatggctgtggatcaagaggaaattgtaaagtacgtcacgaaaaataatgaaaaaccggcgcgcgcctttgtatcgcctggatttacacagcctgacggcaaagatttccgtgaagcaggcggagacctgatcaagcctaacgaaagcaaagcgaagcagctgctcgaaaagggcatgaaggaagaaaactataataagcttcctgcgatcacgcttacttacagcacaaagccggagcataaaaagattgccgaagctattcagcaaaaattgaaaaatagccttggagtcgatgtgaagctggccaatatggaatggaacgtatttttagaggatcaaaaagcgctgaaattccaattctctcaaagctcatttttgcctgattatgcggaccctatcagttttctggaagccttccaagcgggaaattcgatgaaccgcacaggctgggccaataaagaatacgatcagctgatcaaaaaggcaaaaaatgaagccgatgaaaaaacacggttctctcttatgcatcaagctgaaaagctactcatcgatgaagcgccgatcattccggtttatttttataatcaggttcacctgcaaaatgaacaagtgaagggaattgtccgtcaccctgtcggctatatcgatttaaaatgggcagataaaaactgatggaggtgattgaggaaatactgcttctttatgcgaaggagcggtattttttctctttcttgcacgtatacgtagggtgcagagcaaatgaaaggagtgttttcgttgaattacaagccgaaagcgctgaaaaagggtgatacagtcggagtgatcgcgcctgcaagtccgccggatccaaaaaagcttgacaccgcgcttttatttttagaagagctcggtcttcaggttaagttgggcaaggcactgaaaaaccagcacggctatttagcgggacaggatgatgagcggctggcggatctccatgagatgttcagagacgatgaggtaaaagcagtgttgtgcgcatgcgggggttttgggacaggacgtatcgccgcgggcattgatttcagcttgatccgcaaacaccctaaaatcttttggggatacagcgatattacgtttttacatactgccattcatcaaaacacaggtcttgtcactttccatggcccgatgctcagcacggatattggccttgacgacgttcacccgctgacaaaagcgtcatataagcagctcttccaggagacggaattcacctatgcagaagagctttctccgctgaccgagcttgttcctggaaaagcggaaggcgagcttgtcgggggaaatctgtctttgctgacgtctacactgggcacgccatttgaaattgatacgagaggaaagcttttgtttattgaagatattgacgaggagccttatcaaatcgaccgaatgctgaatcagttgaaaatggcggggaagctgacggacgcggccggaattctagtttgtgattttcacaattgtatcccggtgaagcgagagaagtctctctcgcttgagcaggtgctggaagactatattatttctgcgggcaggcctgctctgagaggatttaaaatcggccactgctcgccaagtattgccgttccgatcggtgcgaaagctgctatgaatacagcagaaaaaacagtcgtaatagaggcgggcgtttcagaaggggcgctgaagacatgaaaatcattcgaatcgaaacaagccgaatcgccgttccgctgacaaagccatttaaaaccgcgcttcgcactgtgtatacggctgaatcagtcatagtaaggattacttatgacagcggtgcagtcggatggggagaggcacccccgacgttagtgattacaggagacagcatggatagcattgaaagtgccattcacaatgttttgaaaccggcattgcttggaaaaagcctgtccggctgtgaggccgttctgcacgacatccagcatcttcttacaggaaatatgagcgcgaaggctgctgtagaaatggcgctatacgacggctgggcgcagatgtgcgggctgccgctttatcaaatgcttggcggatatcgagatacgctggaaacagattataccgtcagtgtcaactcacctgaagagatggcagctgatgccgagaattatctcaaacaaggctttcaaacgctgaaaataaaggtcggaaaagatgatattgcaacagatatcgcccgtatccaggaaatcagaaaacgtgtcggatcagctgtgaaactgcgtttagacgctaatcaggggtggaggccgaaggaagcggtaactgccattcggaaaatggaggatgcgggtctaggcattgagcttgtcgagcagcctgtccataaagatgatctcgctgggcttaaaaaggtgacagatgcaacagatacgccgattatggctgatgaaagtgtttttacaccgcggcaggcgttcgaagttctgcaaacccggagcgcagacttgatcaatattaaattgatgaaagcgggcggcatcagcggagcagagaaaattaatgccatggcggaagcctgcggggtggagtgtatggtcggcagcatgatcgaaacgaagctgggcattacggccgcggcgcattttgcggcaagcaagagaaacatcacgcgctttgattttgacgcgccgctgatgctgaaaacagatgtattcaaaggcggcataacatatcgcggcagcacgatttcgatgcctggcaaaccgggcctcggaatcatcggggctgcgcttttgaaaggggaaaaagagcaatgatgcacactgtcatatcagcagtggccaacatctggacagcgcctgattcacctcgtccgtctgatcaattcatgcttcaaccgactgtaatgatcagagactggctcgagcgcatgacgtatgatgaacggcttggattatgtacagacaatgtaatccaaactcaggttctctttggcgaaaaggtacttgtgacggcggaacaggggaatgggtttctgtgatcgtgcctagccagccatcccgaaaggatccgcgcggatacccgggctggatgaaaaagtaccagctggaaaaaacaaagcccatccatacacaacacgatgtgatgatcagcaaacctgctgcctttttgtacagaagcaatggggaaaaggagatcgaattaagctttttgacggttctccacctcattgcaaaagaaaacggatattttaaggtttcgaccgtttttggggaaaggtttgtgaggcaaagtgatgcagtgcctgtcagccaacagaaagggactgctgaagacatcattcaaacgggtgcgttttttcttggccttccctacctgtggggagggatcagcgggtttgggtttgattgctccgggtttatgtacagtatatttaaggccaatggataccgcatcccccgtgatgcgggagatcaggctaaggcggggaaggatgtcccgcttgatgatatgaaggctggtgacctgctgttttttgcttatgaggaaggaaaaggagcgattcatcacgtcggtctctctgttggcggcgggaaaatgcttcattctccaaagacgggaaaatcaatcgaaatccttacattaaaagaaacaatctatgaaaaagaactttgtgcggtgcgccgctgtttttcagaataaggagggagacaaatgacgccactgcctttgttagaggtcagcaagctaaaaatgcattttgacgcagggaaaaagcggacagtcaaagccgtcgacggggttacctttcagattcgtgaaggagaaacgttcgggctagtcggggaatcagggtgcgggaaatcaaccttggggagagtgctgatgcgcctctatcagcctacagaaggaagtgtggtataccgcggcacaaatcttcatgtactaagtgaaaaagagcagtttgccttcaaccgcaaactgcagatgatttttcaggacccctatgcttcattgaacccgcgcatgaccgttcgagaaattattttggagccgatggagattcacaatctctacaatacccataaagcgcggcttctcgtcgtggacgagctccttgaggcagttgggcttcactccgattttggcagccgttatccgcatgaattcagcggcgggcaaagacagagaatcgggattgcgagagcactgtcgctgaatcctgaatttatcgtggcggacgaaccgatttctgctcttgatgtctcggttcaagcgcaggtggtcaatctgctgaagcggcttcaaaaagaaaaagggctcacatttttatttattgcccacgatctttcgatggtgaagcatatcagtgacaggatcggtgtcatgtacttagggcacatgatggaaattacagagagcggcactttgtatcgtgagccgctacatccctatacaaaggcgcttttatcctcgattccgattccggatcccgaattggaggacaagcgtgagcgtattctcttgaaaggggagctgccgagcccagtcaatccgccgagcggctgcgtgtttcggacccgttgcccggaggcgatgcctgaatgcggggaatcccgtccccagcttcaagaaatcgaacccggccgctttgtcgcttgccatttgtatcgaactgctgaaacgaaggaaaaagtgagataaataaaaagagtggctcctttttactagagccactccatttgattatacttgatgtaaaaactttacacaaaccgggtaagggacagaaaccgttgatgggaggagtgtcaatcggccggtttctttgtctctttcaaacaagacaaggttgcctgtttcttcatttgaagcaacgaggaacccttccgttgggtcaaatacaaagtcacgaggccagtttccttctgtcgacactctttctacgaaggccagctctcctgaatattgattcacttcaaatacggcgatactgtcatggccgcggtttgcgacataaacaaaacgtccgtcctgcgtgacatgaattgcgcttccctggctgttatctgtaaaatcatcagggatggcagaaacgacttggatttctctaaattcgccggctgtcgggttgtattcaagcgcaatcacttcattgcttaattctgtcatgacataagcgtatttttctttcggatgaaaagcgatatggcgaggtcctgcaccgggagcgaaggaatggcttccggattcagtcaatacgccgtctttcatcttataggtgtacagcttatctatacctaaatcaaccgctaccacataattgtgttcaggtgtgaaccccgcgtagtgtgtatgcggtttttcttgtctttcgtgcggccctcttcctgtgtgagcggcctctgaaacaggtgattgcaaactgccgtcttcctgaaccggaaaaacgtgtaccttcccgctgtgataattggcagtcagtacgaattgattttgatcatcaacgcttacgtggcatggcgaagggccatcaattaactgatgattcagaaatgtcaattcgccgctgtttttatcgatttgataggcagcaactccgccttggccgtctgctttttcgatggagtaaaggatggtgttgtttttattcggcgccacatatgtcgggttgcccagcttagcggccagctttggctcgctcaatgcttttttctcagtatcaagctcaaatgaataaattccttcgcttccgccttttgtatatgttcccacatatcctatgtattttgtcatgcgatttcccccttaaaaatgatgtcacctctatattaacgtatcttgctaaaataagctgttcaaaacatgaaaaaggggaagattcttcaatcgcctcgaatcagcggcattgtgcagcacctgaaggagccgcccgatttaataatttctgacaggtcaatttcgataatgtgatagcctcttttcgatagctgttgattgacatggcggttgccagggagactgatgatcgtttttttttcgattgaaaggacgttggtgccaagcgtaaattgttcgtcctcgggcacctcaataagatcataacgttttgccagcatatcggctgcctttggctcaatggcttgtggataaattaacgcttcgctttcagatacaatgttaaatacgcagtccaaatgcaaaaatttttcatgcagcttcactggaacgatcgtgtattcaggaagtgcctcttccagctggccgatagctgaaatgtcggtgcgctggctgattccgacatagacaatgtcatcatcgataatgacgtctccgccttcaatactcgtatcaagcatgcgggtgtaagagataccttggctgtgaaaaaaatcttttataacggcttcttctccttggcgaatcggttcagtcatgctcgacagaaaggctttttctccgatgacaaaccctatatccctagtaaaaacctgttctgggagtccgtcgcgaacgggcaaaaggacgacctcaacgttgtgtgacctaagtgcctccactaaacggctgtgctggtcgttggcggtttttacatgaatattgtcatcttcaaaatgtttttgtgtttcgtttataacatcttttatggtcatgtgctcaggtttgcataagatcactttctgaagtgtgccgtattccgttcggcatactgttttgtgctgagttttcgggatggatacgtccatttgtttttcctcctaaagtgtgaagaatacatttattattccctcatcatgaaaatcattaaaccattttaaattttagacaaatggaagagaatattgtttaataggagaatataagtgcatttagctaaaagatcagacatcaaaggggagaaaggtatggaaacaccggaaacaagattttgtaaagagtcaaaggttgtaaaaaccagcagggtgttcccgcttgacacgaacaaccataatacgctgtttggcggaaaattaatgagctacatcgatgacattgcctctatttccgcggcgcgccattgcagacgtgaaaccgtaacggcttcaatggattctgtagattttttaaagccgatcgggcaaaaggattctgtctgcctagagtcatatgtgacatgggtcggcacatcttctatggaagtatttgtgaaagtcattaaggagcatttgatgactggcgaacgggaactcgctgccacatcctttttgacatttgtcgcattagattcaaatggcaagccggtgcctgtgccgagagttgtaccggaaacagaagaagaaatcatgcttcataatacagcagtacagcgcgctaatgaacgaaagaaccgcaagaaacacagccaggcgcttgcaaatgcgctcggaactgataaaccttggtgacgttaaacccaaaacataagttgttttgggtttttttgtacttttcaatggtgattattacaatggttagtccgtttttgctaggggattctataaaaaagtaacaaatgtcatgttaaattgataattttgtgacaactttattaaagattcattttagatatatcttttattcctaagatcatgtattttaaagatatattctaaatacatcttttcgaaaggattgtttatacaatgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgccgttattgcagctgcggcaaacattgaccaattaggaaacatcattccggttgtcaaacaaatcggccacaagcaccgcagtatcggaattaagcctgagcactacccaatcgtcggtaaatatttactgattgcgattaaagatgtattgggagacgctgcaacccctgacattatgcaggcatgggaaaaagcgtatggagtcattgctgacgcgttcatcggaattgaaaaagacatgtatgaacaggctgaagagcaagccggcggctggaaagagtataagccattcgtaatcgcaaaaaaagagcgggaaagcaaagaaattacatccttctatttgaaaacggaagacggcaagccgttacctgaattccaagcagggcaatatatcagcatcaaagtgcggattcctgattctgaatatacgcatatccgccagtacagcctgtctgatatgccgggaaaagactattatcgaatttccgtgaagaaggatggtgtcgtgtcttcctacttacacgatgggctgcaggagggagattcaatagagatcagcgcaccggcaggggactttattttagatcctgcatcacaaaaagatctcgttttgatcagtgccggagttggcattacaccaatgatcagcatgctgaaaacatctgtttccaaacagcctgaacggcaaattctgttcattcatgcggcgaaaaacagtgaatatcatgcattgcgccatgaggtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacacagatgcggattactatatttgcggttcaccgtcgtttattacggcaatgcataagcttgtatcagagctcggatcagcgccggagtctatccattacgagctattcggtccgcaattaagtttggcgcagtccgtttgaacacatacatgaaactcttctcctttcagagaagagttttttattgagatataagtaggtagacaaacgccggtttctacatccggacaatcacagacccgccgccatttgtgcatacacggttttgctgttcttgcattgttctcagcaattcattgtttacctcaatcgctctaattagttgctccatccttagctccaaaccggccagcctgtcgattgtttgctgctggtagcccgtgggttgggaagccaatggcagctcaaagggccaaagggtattcgacttctgatttttcatattgcgtattgcgcctccaatcggtgtcactttctattatgttatgttcaggcgaggtgcacgttcgcctatttagacactgatgcatagagggcctgccaaggggcacaataggctcaatatgaccagcggatggaggtaaagatcggtgttatggatgatatgggtatttttactgaagccagttatcgtattttcgattgcatatattttatttcggcttgccggtaaaaaagctgtgtcacaaatgaacaattttgatctgcttttgaccttcgcaatcggaaccattatcagtgagccgatccttacatccaagctgccgatgtcaatttattatgcgggtgcttttttggtgctttatcttatcatgagcaagctctctttatctaataaatggcgatggctcctagtcgtgagcccgactgtccttatccggaacggggatattgatgaacgcggccttcgtaaagaaaggctgactgttaatgaactgctcggaaagctgagggaaaagggctatgccgacccggctgacattgatcttgctatcattgaagaaacgggagaagtaagcgtcatcccgaaagaggaagcgagagcggtacaggtgcgggatttgaatatggaagctgaacggaattttatcccgattccgctcatactggatggcgaaatccttgatcataatttgaaatatctccaaaaaaaccgatcctggctgtttgagaagcttgaggaaaaagggtacagccccaaactgctgtcttcgatcaccttaggcacgatgaatgcgcgaggtgatatatcccttgatttaaatacctctaatgacccgcagcatgatccttacttatataaaccgggaaataacaattaagatggctctctcttgtaatgagagcttttttcttttttaaagggaatttttgtttggtgtcaaatgtacctagttaggaggggaactgaacatgaaggacttatccataagaaacgacatggcgccaacggttagtctgctgtattccgcagtggaagaaaatagtctccgtctggcttctatcgtaagccatatgacacacagtgaactttactataaggggcgctgccaaataaaaaacagcacggctcagcttttgcaccatatcacaaatgttgatatcagatgggtctggcgtatcaaggaaaatcggatacctaaccatattgaacaggcatacggccccatgacagatgaaagcggacggctgcctgaaccggtgaatcagccagacttagatgaactcctgaaaagacatcagcatgtagtagacgagctgaaatcggtatgcttcactttaactgaaaatgctttgaaccagccgctttctttcgaaggtgacaccgcgacgatacgatggggaatttggcatatggcagatcataaccgctatcatcaggcacatattgaagctctcaaaaaagaatggaagcaggatgtggcgaagtatgaacgctaaaacgaagcttgtgaccgatcgaattcgtttgcgctgtatggaagatcgggatcaagccaatttgtttaggctgctttttaatgatcctgacgtcatgaaatattattccgatttaaaagataagaggcaaacccgcgagtggatcaattggaaccaacgaaatgaaaaagggtacggcgttagtctgtggatcgccgaagataaccggacaggggagtttttggggcaatgcggcatcgttccccagcagatcgaaaatcaaaccgtaatggaaattggctatatgtttgcccgccgccactgggggaacggctatgcgcaagaagcggctcgggcctgtctggactatggctttaacgagcggcagttcggcaaaatggcagctttgattgatccgggtaacaaagcgtccatacgggtagcggagaaaatcggcatgcattacagcaaaacgaccagaaaatggaataaaccgatcgcggtatatgaaagaaaatcttacaattgaaagatagagctgagtttagtatcatgatatcatgtaaagttttctagggttccgcatgtcaattgacatggactggtccgagagaaaacacgtacgcgtaaatagaagcgcgtatgcacacggagggaaaaaagcccgggagagtcaatctcatgtgagacgactgtccggggttttttgttttcggagaatcctaatagatagaaaggaatgactcaaaatgaaatggggattggtcgtgcttgccgctgttttcgaggttgtttgggtgataggcttaaagcacgctgactcagccttaacatggagcggcactgccatcggcatcatattcagcttttaccttctaataaaggcgactcacattctgcctgttggtaccgtgtatgccgtctttaccgggctcggcacagcgggaacagtacttagtgaaatcgttctgtttcatgaaccgattggatggccgaagctattgttaattggcgtgctcttaatcggtgtaatcgggttgaagcttgtgacacaggatgagacagaggaaaaaggaggcgaggcataatgctgcactggatcagtttactgtgcgcgggctgtttagaaatggccggcgtggcccttatgaatcaatatgcgaaagaaaaaagcgtgaaatgggtgctgttgatcattgttggttttgccgcttcattttccttgctgtcgtacgcaatggaaaccattccgatgggaacggcttacgcggtctggacaggaattggcaccgctggcggggcgcttgtcggcatcctcttttacaaggagcagaaagacgccaaacggatcttctttatcgcgttgattttatgctcagcggttggtttaaaaattctgtcataaattgatttttatcaaatcttcagtataatggataaatagtttagacttacaaagataagagggattattcatgaaatcatatatgactcagcggttggacgaataccgtgacggaaatgaggataaagggcggctcttggtcagctgccccgatcagccgggtatcgtctctgcagtttctgcgtttttatttgaacacgatgccaatattatagaatcaaatcaatatacgacagaccctgaaggcggccggttcttcctgagaatcgaattcgactgcgcgggcattcgtgagaaaaaagcatctcttcaggcggcgtttgcctctgtagcggaaaaattcgacatgacatggagcttaactttggcaagtgaattgaagcgtgtcgccatttttgtttcaaaggagcttcattgcctgcatgagctgatttgggaatggcaaaccggcaacctgatggcggagatcgctgttgtcatcagtaaccatgaggaagcgagagagctggttgagcgcctgaacattccattccactatatgaaagcgaacaaagacatcagagcggaagtcgaaaagaagcagcttgaactgctggagcagtacgatgttgatgtcatcgtgcttgcacgctatatgcagattctaactcctgattttgtttcggctcatccgaatcgcatcatcaatatccaccattcatttctgcctgcttttatcggtgcgaatccgtacaaacgggcttacgagcgcggcgtgaaactgatcggtgcgacatctcactatgtgacaaacgatcttgatgaaggaccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgaaagaggcccgcgcaaagcgggctatttttgatgacaaaaaaccttgacaagtgtcttttttctttgcataatataaaaaaatcattgagcgttgaagaggattagtaagcagatctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacaaatagcaaaggaagcattgatgaggcaaaaatcagagagcatgttcaggcgatttccgtgttaaaaaaagcggggcatgaaatgattctgattacctcgggtgccgtagcggcggggttttccagcctcggatatccgtcccgtcccgttaccatcaaaggaaaacaggcggcggccgcggtcggacaaacactgttaatgcagcaatatatgaatcaatttaaacaatactcactgactccgggacaaatccttttaacgagaaatgatttttcgaaaagagaacggtatcgaaacgcgtatgctacgataatggaattattggaacgcggcgtcattccgattatcaacgagaacgattctacatctgttgaagaattgacattcggagataatgatatgctttctgcgttagtcagcggattgattcacgcggaccagctcatgattctcaccgacattaacggactgtatgatgccaatccaaatgaaaatcctgaggcgaaacgatttgattatttgccggagatcacgcctgaattgcttggatatgcaggttcagccggatcaaaggtcggaaccggcggaatgaaatcaaagctgttagccgcacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaggaggcgataatccataatggaagcagccttttgcccgctggcgttgtgggtgtgaacggaagctttccgaaaggggcggttgtggaagtcaggggaccgggcggcgtgatcggcaaaggccaaacccattactcctctgaggagattatggaagccaaaggcaaacgcagtgacgaacttgattttgagaaaacgtttgaggttattcataggaatgactgggtcaatgtaaacgactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaacttgattttctcttggcggagaatgcaaaagacattgagaacggaaaagagaatggtttaacaccggacatcattgaccgtctcacattggatgagaaacggatacgcgatatcgcggacgcggtggagctcttaatcgacttagcggacccggtcggcgactctcttgaaacgattgaaaaagaaaacggcctgtttattgaaaaaatccgtgtgccgctcggtgtcgtaggaatgatttatgaggcgaggccaaacgtcacagttgatgcagctaccctttgcctgaagacagggaacgcggttgttctgcggggaagctcctcagccatccatagcaacaaagcgctcgtcagtgtcattcacagagcacttgagcaatcagcgcttccgattcacgctgtgcagctgattgaggatacgagcagagagacagcaaaagagctctttacgttaaatgatggtttagacgtattgattccgcgcggaggcaagaaactgattgatctcgttgtgagagaatcaacagttcctgtactagaaacgggagcaggaaactgccacatattcattgacaaaacagccaaaccgcaaatggcagaaaaggttgtcgtaaatgccaaaacgcagcgcccttctgtatgcaacgcgattgaatcattgctgattcacaaggcttgggcgagacagcacgggaaagaattgctggaccagctggaaaacgcgggagttgaaattcgcggtgatgaattggtatgtgaacttcatccttcaagcaaacaagcatcaaaagaagattgggaaaccgaatttttagcgcctgtcctcagcgtaaagacggttgaaaacgtccgagaagctgtaaagcatatccaacaatacggcaccaatcattctgaagcgattttaactgaaaatgacaaaaacgcggcatattttcaaacggctgtcgatgctgccgctgtctatcataacgcgtcaacccgctttaccgacggctttgaattcggctacggagccgaaatcggcatcagcacgcaaaagcttcatgcaagaggaccgatggggcttcctgcactgacttctacaaaatacatcattaaaggaactgggcaaatccgtgaatagcggggcaatgttcaatgaaaaagcttatctcgtaatgagataagcttttttatacgtgaaaaattgacataccaaaattaattgtgtacaatttaattgtataaaatatattgggggaatgaaaaatgagtcagccattatttacagcaactgtttcagcggtaggaggaagagaaggaaaggtcatttcatcagaccgcgttcttgagcttgatgtcgcaatgccggggacaccgagagccaagaaattagaaaaagcgacaaatccagagcagctgtttgcagcaggttatgcagcttgctttgacagcgcattgcagcttgtcgcaagaacagaacgggtaaaagtagagacagaggttacagcgaatgtaagcctgttaaaggatgaagcggaccagggctacaagctgggtgtgacactgcaggtaaaaggagaaggagtcagtgcatcagaattggaggcgcttgtgaaaaaagcgcacggcgtctgcccgtattcaaaagcaacctccggaaatatagatgtgacacttgaggttactgaataaataaaaagaggatgccttgtacaaggcatcctcaatttttttgatgaagtgtttccagcaatgtatatagagcggactttaactgtttgagatcctccccagactgctttgagagccccagaattgtctctggaatgtcaaccgctttttcttttaataacgctccgtcctctgtcaggctgatcaacacggaccgctcatcctcttcagatctttttctcgtaatcaaaccctgttgttccattcgtttaagcatcggagtgagcgtccctgaatctaaatacagctgttcgcccatttttttgacagtaagcgtttcatgttcccataacaataacaaagccaaatattgggggtatgttatattcagcttatcaagcagcggcttgtattgctttgtcatttcccgcgaactcgcatatagcaaaaaacaaagctgattctccaatttcatatgatcaaatttattttccattttgttcaccaactctttttgtcattcgattctattgtatctgaaaaacctcacttttcctattctcggcaaacatagcatgtttaaaaagatcagaaagggaaatataacaactagatacaaataaggaggttgggaaatatggcactatttacagcaaaagtaaccgcgcgaggcggacgggcaggacatattacatcagatgacggtgttcttgattttgatattgtcatgccaaatgccaaaaaagaaggacaaaccggcacaaatccggaacagctctttgcggcagggtatgctgcatgctttggcggcgcgctcgaacacgtagccaaagagcagaatatcgaaattgattcggagattgaagggcaggtcagcctcatgaaggatgagagcgacggcggctttaaaatcggtgtcacacttgttgtgaacacgaaagatttagatcgggaaaaggcacaagagcttgtcaacgccgctcatgaattctgtccttactcaaaagcaaccagaggaaatgttgatgtaaaactagaattaaaataatgaccggcatcctgagtgttctcaggatgttttttggtgtcggagcgggtgtgatcttttcgaagtctgagacatttcttataaatggatttagacttatatccattatgaattgacgcggaacggggtaggggtgggcacagaaattgataaaacgtcagagaagcgatcacagcgtttaaagcctgcaaaagttacagatgaagggggcggctggctcggtgtctgccaagctgaattccggcgcgcataattgctgttttgtatttgcacagggcatagcgctacttggagaaataacaaggaccaggccgcgcatgcctgatccttttaatattctttcttattggcgaagttccgccatgcttgaaaaggggataaatgctctgttagtgtcacttgataaaaggggatcgttctttcttcatcaggtttatcaatttctttataaatgaatgaatcatcaaacccggcttcggcagcgtctgtgtgctcagctgcatagaaaacggctttaggccgggcccagtagatagcgcccaagcacattgggcatggttcacagctcgtatacaaaatgcagtcatcaagctggtatgctcctagcaccttacaggcttttcgaatagctgtgacttccgcgtgggcagtcggatcattgcttgttgtgacgttgttctgtccctctgcaataatggctccgtctttcacgataacggctccaaaaggcccgccgattcctgcattcactccttcacatgcgagagtgacagcccgttttaagaacgtttcatgattcatcccaatccctcctgtcaatagagtgttattagtatagccgaaaaaaatgcaaagaacattcttaaaaaagtgcaaaataaacaaagtaattgggggatttgctaaaataagaaactattgtggctgtattatagaaaaaaaccatctgccaaatgcagatggttttttcaaattatactagctgtgtctgctgtgctcttgcctgttttgcagcttcaaccatgtttttcaatgctgcaaccgtttcttcctgctgtcttgttttcaatccgcagtctggatttacccagaagcggtcagtcggacagacggcaagcgcatcaacgataatattgtacatttcttcagttgacggcacacgagggctgtgaatgtcatatacaccaaggccaagccctttcaaatacgggtggttttttaagtaatctaaaaatcctccgtggcttctgctatgttcgattgtaatcacatcggcatcaagatcattgattgtatcaacgatatcttcgaagttgctgtagcacatatgtgtatgaatttgtgtctcgtttttcacggaagaagtggttaatctgaaagcttctgccgcccaagtcaaatactcatcccaatcgcgggttttcaatggaaggccttcacgcaacgctggttcatcgacttgaatgatttgaatgcctgcgtcttcaagcgctttaacttctttgcgaagggcaagcccgatttggaaggcgatttctttcctcgagatgtcgtttcgagggaaagaccagtttaagattgtaaccgggcccgtcagcattccttttacatgcttggaagtcaatgactgtgcgtagactgtgtctttcactgtcatcggttcaataaattcaacatctccgtaaatgactggcgggcggacacagcgtgagccgtatgattgaacccaggcatatttagtgaaggcgaaaccggccagcttttcaccgaagtattcgaccatgtctgtccgttcaaattcgccgtgaacaaggacatcaagctccaattcttcctgaatatcaatccatctttttgtttccgcattgataaagttttgatactgttcatcggaccactcagctttccgccatttttggcgtgcgctccgcacttcagcagactgcgggaagctgccgatcgttgtcgtcggcaaaagcggaaggccgagagattcattttgcagggctaaacgttcttcaaacggaatcgggcgcttgaagtctttatcagttaattgctcaagctctttcttttgttcagaattggcgcctgttgcaaactgtttaagcgcctggatatcagccttagcctgctgaatctcttcgctgatcgccgcttttcctgatactaagccttctttcaaagctgtcagctcggccagcttttcttttgcgtaggataatccgttcaataggtctttttccaaatgctcatcagggtgtttcgctaccggaacatgcagcaggctgctggaaggctgaatccacagttcatcaacttttgcaatgctgagaatatcaagaacggcatcgagacgctcttcaaggtccgctttccaaatgttgcgtccgtcgataacaccggctgccagcactttgtctgtcggaaagccatgtgttttaagctgttccaggtttctgcctttgtcgtgaacgaaatcaaggccaataccctgaaccgggtaagagatcagctcttcataagcatcaacagaatcaaaatacgtctgcaaaagcacattcaaggatgaaagctcacttgtaatgctttcaaataattcttttgcaccgcggacatcttcactagaggcggtaacgagcgccggctcatcgatttgaacccattttacgccttcttcttcaagctctttcaaaagctgtacatataatggcacaaggcgtttttggatcgcttttgcttcagacggttcatagcctttagcaagcgtaacgaacgtataagggccgacaatcacaggctttgtttccacaccgtattcctgtttgatccggcgataatcttcgagttgtttgtttcttgtcagacggaactcaatgctctcgtcatattccggaacgatgtaatggtaatttgtattaaaccattttgtcatttcactagatacggcgtctttgattccgcgggcgatagcgaagtatgtatcggtagcgtcagtcaaatgtctaaaacgtttcggaatccagttgaagctgactgctgtgtcgagtacatggtcatactgtgtgaaatcagaaacaggcacaacatcaatctgctggtcaatttgtgtttttactgcggataaaaatagttcgtcgatttgcttcaaaaacgtatctttatcagtactgcttttccaatacgcttcaagtgcttttttccattcccggttcagtccgattctcggaaatcctaaattcgatgttttgatggttgtcattgtttctcctcctttatatgtaaaacactctctttaacccgcggatacaggctgctaagaggttttctcacaacaaaaagcctctttcccatgagagaaagaggcttttctacgtaaaacactgcctctctcatctctcagacacaatctgatggaattagcaccgtgccttatgagacatcagtctcggcgcgaaaagcagtgcgccccatttcacaatggtattacggtcggttgctgttggggtcaaaaggccaatccctcgcccaactctcgataagagaaaatgttattaattttttgaaaagttgaatcatttgttggtaatcttaacagtaattcaaattcattgtcaacatagaatttgaaatttttatttatatgatgtggtgtatattatataagaaaaataatcttatagggtcaacaaatgtgattgctctgctttttctgcgagctcatcaggagctgttaaatacaggaatccattgcctgccagcgtttttgcaatttcaagaggaagtgtcctgcggattagctgtgcgaaaacttcagattcagaaagctttctttgaaatgattcttcttcatagcttttgattaaagcaagcgctccgctgacatgaggggcagccattgaagtgccggtcagcttaccgtacttcttgttgggaagggtggataagatattttctcctggtgccacaaggtcaatctctttattcgcgttagaaaattctgataattctcgcgctactgaaacagatccaactgcaatgacttcgttataagctgcggggtaggaaagctcttctgtgcgttcgtcgccgtcaccctcatttcccgctgcacaaacgacaagcactccgtttttgactgcgtttttcactgcttcttccagctctggcacatcgcttggccctccaagggacattgagatgatgtcgactttctgttccaccgcgtagttgatgccgttgattatccattcgtattgtccgctgccgttctcgccgccaagaaccttcacaatcaataggcttgcctcaggcgcgactccggcaatgcctccgtttgaatcattagctgcaatcgttccggcgacgtgtgtgccgtgtccgttgtagtcggaaatcgcatcttccttgccgccgtcgtcatccgtgaagttctttccgccgatgatttgattttttaaatcagggtggcttgtgtcgcagcccgtgtctaatacagcaactttaatatttttgccttttaccccttttgcccacatttctggcgccttaatcactttaatgccctcaggaagctcgtttacatccatgatcttctcattcgtcacatacgggatcaagcggatttcaccattcataaaaaagccctccttttttatgctttcaagtggattcaagggtgttgcctcatattatatgaaaaaagcaagcgctcggacagagccatttgaagcattttgaaaaaataggatacacaccaaagaattagtaatcttcaaaatattggatggcttcggcgtgtatgactgggattcaactgtaagtcaagttataatagtgttggggaaaggagcagtgtcatgaaactgaatgaaaaattatatgcatttttttcagagcatgtggaacaaatggccgaggaatggattgaaacgatggaggaaagtgatccgaattcgctttacgccctacataatgcaacagtaacggaagaattgaaagagcaggacagagaattttaccggcatctgaattacatgtatgttttaccggaaaaacaatttctcgaagagtttcaagagtgggtcattgagctgaccaacgatcaaaaacatcttgacacaccggttcagtatgtcattcgggagtttatgagaaacaggagattatatacgaagtattttgagaagttcgcagaagaaaatgagtcagcgtttgaaccgggagagaagcaaaaatgggcagatttgattgtaaaagtatttgatttcaccatttatacattcgttgatcacgctgaaatgaataccaagcagcaattaaacgcccaaagagaaatgatattggaattaagctcacctgtcattaccctgagcaaatcaacagctctgctgccgcttgtcggtgacattgataccgaacgggcgaagtttattctggaaaacacgcttcaagcttgtgcgaaaagacgtgtggagcatctgttaatcgatctgtcaggtgttgttgtggtggatacgatggtggcgcaccagatctttaaattgattgaggcgcttaatctgatcggtgtccggtcaaccctgtcaggaatcaggcctgaaattgcgcaaactgctgtacagctggggattgacttttcgaatattaccattaaaaccaaccttgcccaagcattaaactatcatcaataaaaaaatccgctatctgtgatagcggattttttatgatgcgaaacataaagatacgagaaaggatcccgcaaataataagaggacgaggcaaaagaacacccagtcgtgccggttcacgctcaatgtcctgtaatatgtccggtttctgcttccagtaaaacctttcgattccatcgcaagcgctgtccgttccgcttttctgatggcgcttgccaatagcggtatggtatatcgttttaacgcactgattttcttaatgatgccgctctccgccgctcctcctctgattttatgagcctgctgaatcagctggatctcatcctttaacagcggaagaaagcgaaagcctgcaatgacaccgtacgcgagctttggtgagagcctgcactgctggacaaggctcagcataaataaaatcggatcggttgtaaaaacaaacatcatcgataaggcggaaaagcataaaatacgaaacccaagggagatgccgacagacacattatcgctgttaattgagatagggcctgcttgaaacaaaaaattatccggtgttgtcggcacctttccaaaaactgcggctgtccacacgcacccgaatgctaaaatcaaaaacggaatcgtaaacaacaaccattttttcaatgggattccggccgccagtagaacgcccgcaacgatgatgatataaaaacatgccggagtgtaagggttgtaaataaacgacagcatgacgacacaacaaaaaaccgccgccgctttcacagtcggattaatgagatgtaacggctgcttcatcacgcacctcctcttgatatgccatccattcatatagaagaggaagggtgagctttgctttttggacaagccctgtttcttgagaaaacaactgcgctggagatccgtcaaaggccaggcccgtatcgtgaagcacaagcacgctgtcagcatacgaagagactagctccatatcgtgtgtaatcataaggacagcggttccctctgccttgatacgctgaatcatttccatacattcagccgccgtgcgggcatcctggccaaaggttggttcgtctaataataaaacctttacgtcatgcatgagcatagtagctacgctcagtcgccgtttttgtccttggctgatcgcaaacggatgatgatcagccaaatgcgcaagaccaaaacgctgcagcaggtgttgcgcttttttctcagtttcagcatttgctttctggccgaacagaagctcatcatacaccgtatcggtgacgaattgatgctcagggttttgaaaaacaaatcccatccgtttacgcaattctttttctttatatttctgcagcggctggtcataaagaaggattttgccgctttgcggtttcatgagacgggccagaactgataagagcgtcgattttccagtgccgttcggaccgacaagcgccgttaaagagcctccgcgcaacgaaaagctgatgtctttgaaaatcgtctgctgtcctctcgcgaacgaaaggctgctgacttcaagcacactctccccagaaggagcttccttctttttggcatgcccggcaggaataggctctttgaatagcatttcttttgataaagtaaacggcatactcagcttttcctgcagatgacagacctttggaatggcgatgcccaatttctttagtgtctccgcttcatgctgaaatagatttttcgtcaggccatccagcgcctttttgcctgatttgtcgagtacgatcgttctctcaatccaaggcgcccattcatcaagctggtgctcaatgacgaggaggctgaaacctttttcccgctgaagatccttcatcagatgaacgaactcccgcgctgagaaagggtctaaaagagaggtcggctcatctaaaataataagctcaggctccatcgccaaaatacaggcgagagccactttctgcttttgtcctcctgaaagggttgagatcgttttttcttttaaatgggtaatgcgtaatttttctaatacggcgttgattttctctgtcattgcttcttttggaatttgcagattttccagcccgaacgcaatttcatcctctaccgtcagcatgcagaactgctgatcaggatcctgaaaaacgaccccggcatgctgagcaatcgtttcggaggtttcagcatctgtgaccggcttttgaaatagaaagacatgtccggactgaatgccgtcgcaagcctccggatatagaccgtttaaacaaagggcgagcgagcttttaccgcatccgctcggtcctaataataaaacacattctcctttttgaagctcaaacgaaatgtcttgaaaaaccggtttctcgtcttcttcataagagaagctgagctgctcaaccgtcagaagctcatcaaaggcttgcatgttctgacgcccgcttccgtttctttttcagttcctttccgagtgccattccgtttaacacacctgtataagcgagagaatcgctgacagcttttccgagaagccccgccaaaagcgcgccggaaatgaggcggatcacaagcataatgagcagataacctggtgaataggctgcatagccagaaacaaagagatcatagataaagctggctactgaagaccccataccggccagcataaggacagggagagagtatgctttccagcgtgttgcaagaaatacagcctcagccccgagcccttgaacaatgccaatgacgatgaccatcgggccagacggatttcccagcaggcactcaacgagagcggcaatgatttcagaaacgagcgccgcacccggtttttgaatcatgtacgcggcgatcacagaaacgataaaccaaatgccgtaaatcggttcataggcgattggcccaaacatacctgcaagcacgtttccgaaatgtgtaaataataaataaacaacggcaaatacgatactgataacggacatgatgacaatttcttttactttccagcttttcattttatccctgctttctgttttttcttgatggactgttagccgaaagattcacagtcatggtgatgtggtttgtttgctgctcagccatgcggaaaacggcttccaatgtgctgaatacgtcatgcgcatccccgtcaagctcgctcgcgtaatggacaccctgtacgaaagtgccttgggcttttgcaatgtcgacagccttcataatcaatcccatataatccggctcgttcattggataaagggcaaattggcacggcgcttccgccttcaagcctcggacagcatcttcattgacacgcttatcacctttggaaagatatgtatccccctgtgtgtcacccgggcatccaatggaaaacgtgccgttcatgacgatgtgttgttcgctgtttgctgcatgaaggtaaatggcttttgcagcatcgaatacatgatcaatcgatccgcgtaacaccgtgctgatatggtcggttttcgtccataccttggatgtatctgtttttttcagcgcagacttgatcacactgataaaatcatccgtcatcggatataaagagaagcgaaaaccggcgattctgcttgtaccgcaaatatgctccatttctccgacctcctgtttttttggtaaaataaaaaactgcatatcctaagggaatatgcagtcatagatcgattaagcgcacaaaaaaatacaccattcggtcaacctgcacttccccacgctggtattatccagatcgggtcataagggatcaaagcgcgtttcttccgcgctttatctcagccaaaacagcacccctagtgctttccgtatacaattttttattttgacatcataatagatgataagaatcattttgtaaacaacgaaatcatttttttcatatagggacgggagaggatgatcaaatttggaaaaaggacacatattaattgtggaagatgaagaaaaaatcgccagggttcttcagcttgaattggaatatgaaggatacagcgtcaccatcaaacacaatggcacagaaggtctggatgcggcagcgaaaggcgggcattccttggtgcttcttgatgtcatgcttccggggcttagcggactggaagtgctgcgccgcttgagaaaaacggatccgcagacaccggtcatattattaacggcgcgagacagtattcctgataaggtaacaggtctggacatcggtgcgaatgactatgtcaccaagccgtttgaaatcgaggaattgcttgcgagaatcagggcggcgctgcggcaaaatggaacaaaaacggaagatatcggcacctttcttacatatgacgatttgcgggtgaacgaaaaaacccgtgaagtgagacgcggagacaaagaggtggaattaacgccgcgggaatttgatctactcgtctatatgctaaagcatccgcagcaagtgctgacacgggagcaaattctaagctcggtatggggatttgattatatcggtgatacaaatgtcgtggacgtctacataagatacatcagaaaaaaactggactatccttacgaaaaacagctgatccatacgattcgcggggtcggctatgccattaaggggtaaacgatgaagctgaagaccaagattcatctatacacatcaatatcactgttgattttattaattttggtgcataccgcagtctatctcattttttcgtctgcgctgacatcaaaggatgcatcccggcttgctgatgagacggataacattgccgaagcgctgcgtgccgctgaaacagaaggagtggctttgcaggatatgctgcaggcctatcttccggcaaatggcatggtgcgtgtagtgaatggtgatcaaaaagccgttatgacgatcacaaaagaaaaagcctataaagattttcctctctcttttcatagcggagaaacggcagatgtgaggaaacatgacggcaagctgtttgccgaggctgctgttccggtaatttggaccgatggacaagtggtttctcttcagctggttgaaaggcttgagaacacagaagagagtctgtttctgctgaaaatcatcttaatcgctgcaagtgctgctgtctgcattgcttctttttttgcaggcagcttgctagcccgccgaatcatcaatccgatcagacgattaatgatcacaatgaaagacatacagcgagacaaaaaatttaaaacgatttctttagaaggacagtccaacgatgaattgtatcaaatggggctgacatttaatgaaatggcaatgatgctgaaggagcactatgataaacagcagcaatttgttcaagatgcttcacacgaattgaaaacgccgctcaccattatagaaagctacagcagcctgatgaagcggtggggggcaaaaaagccggaggtgcttgaggagtcgatagaagccattcactcagaagcggtgcatatgaaaaaactgaccaatcagcttttggcgctggccaaaagtcatcaagagcttgatcttgatctgaaaacaatcgatctgattgaagcggcgcgcgcggttatgcaaacgctccagtccgtttatcagcgtgacatatttcttgaaacagataaagagagcctgcttgtaaaggctgatgaagaacgcatcaagcagctgttgaccattttgcttgataatgcaataaagtatagtgaaaagcctattgagatgtcagctggaacgaggaatggacggccatttttatcagtgagggatgaaggcatcggaatacctgaggagcatatcccgcatttgttcgaacggttctaccgggcagatgaagcacgaaacagaaaaacaggcggaacgggtttaggcctttccattgccaagcaaatcgccgatgagcatggcattgagctgtctgtcaaaagcaagccgggacaaggaacagctgtcaccatgcaattcagcgaacagaatgggggaggccgatgactaaaacaataaaaacagtatcttttgccgcagcagccattttagttgtcatcatctgtacgtttctcatcattcggcaaacccatgagaacgtattgtcaaaggagactgtcgtaaaaaaagtcgaatcctcttatgaaggcaaggtcacgaaagcaacacaatcaaaggataaaaaaacatatgatataacgcttgaaaatcaaaagggaacttactttgtaaaagcagacgcaatatcggctgacattctttcaatgaatagagtaaaagcagtgaatccatctgccatgacagaaaaagaagccgagcatctcgcgcttgagcgggtgccgggaaccgtcaaaaaacaaacacggcaaagtcgagttgccacttataccatacaaaaagaagatgggaaaacatacgaagtgaaggtagacatgcaggcaaaaacagtcttgtctgccgatcaaatcagcagcaaagatcaacaaaaaacgccgattacgaaaaaagaagccaaaacaattgctgagcgagaaacgggaggaacagcggatgacgcagatctcgaagaaagtgagggcactctcatctttgaagtggacgttgatcttcctgatagcaaggaagcgacagtgaaaatcaatgcctacacaggaaaggtagctaacattgtgtatgaagactgacggtttctcatcaaattctcatcttgctctcgttttcctttcatgttgagtgtgtaaactgtactcatacaaaacaaaggaggactcacaaatgctcaagaaaaaatggatggtcggtcttttagcagggtgcctagcggccggaggattcagctacaacgcgtttgccaaagaaaacaatgaaaacagacaggcttcttctaagacggatgcactcactgaacaagaagcagaagcaattgctaaaacagttgttgacggcacagtagaagacattgacagagacctttacaacggcaaagaagtctatgaagtggagattgaaaaagaaggtgaagactacgacgtttatgtagatattcatacaaaacaagcgcttaatgacccgttaaaggagaaagcagaacaagtcgccataaccaaagaagaagctgaagaaattgctttaaagcaaacaggtggaaccgtaacagaaagtaagcttgacgaagatgacggtgcttacatctatgaaatggaaatccaaacgaagcaaggaactgagacagaatttgaaatttccgcaaaagatggacgcattatcaaacaggagatagatgactaatcaaaacccccgctgcagcggggtttttcatgataagaaaccttcttttggacaatctaagtagaaaaggaggcgaaacgcatggaaaagaaagaggagcaatacatcaatcaggctgaatatgtccctcatccgacgaaggaaggagagtacgccttatttcttcatgaaacgtatcatttgctttctgaagatgacgagacacaaacaacagaataagggctttggcccttgttttgttccgtaattgtgatgtaagcgcatttattacttttttgagttgacacagcttgtttttttctgtaatctcagtgtgtcaattcaattaggaacttcgttaggtgaggctcctgtatggagatacgctgctgcccaaaaatgtccaaagacgccaatgggtcaacagaaatcatcgacataaggtgatttttaatgcagctggatgcttgtcctatgccatacagtgctaaagctctacgattgaaggcgcccgcacgctttttttgccgtgcttctttcaccttcaatcccgaaggctttttttatgcctttaaaacgaaaccaatcaaaggaggtgcggagtatggattctccccattcgagtcaatctgaagaagtacccatatactatgacagcaagacaattgattacacgatgaggagacgaactgccgcaccttctggcgaggccggcacgtctccgtagaggaggtacgagtcccgatggttcaaaacatgacctatgacgaactcattttacgcatcattattttactgcgagacgggaaaatcagggatttcagaagtgttattgatgagcttcagccctatgacatggcatttatttttaaagaaatgccggaaaaacaccgcgcccgctatttatcttatttaactgtagacgatatcactgatatgatcggggagctggaacgcgaatttcagcttgtcgtcttaaataaagtcggaaaaacaaaagcaacactggcgatgaataaaatggacaacgatgacctcgctcaattgcttgaagaaatggacgaagaactgaaggaacagcttttgtccagcatggaagcgtcagaatcaaaagctgtacagctcttgatgaattacccggctgattcagcgggacgcatgatgacaaaccggtatgtgtggattcctcagcattacacggtaaaagacgcggtcgtcaaactgaaaagcttcgctgaaatagctgaatcgatcaactacttatatgttattaatgaaagcaaacagctggttggggttctttcctaccgcgatttgattctgggtgaacctgaagaaaaggtgcaggatttaatgtttacccgcgtcatatcagcagatgctcttcaggaccaggaagaagttgcccgcctgattgaacgttacgattttttggcaataccggttgtagaagaaaacaacgtgcttgtcggcattgtgacggtcgatgatattatcgacgtcgttattcgggaagctgatgaggattacgaaaaatttgccgcttccggtaaagacatcacctttgacacaaaagcttacgtggcggcataccggcgcctgccatggctgattttactcttgtttatcggactgatttcaggaagcattatcagctattttgaagacgcgctgaagcaggttgtcgcgcttgcgtttttcatgccgatggtatcagggatgacaggaaatacgggaacacaatctctcgcggttgtcatcagaggtttgtctaaagaagaaatgaacaaaaaaacgattgtgcgcctgatcttccgggagttcagaacaagcatttttatcggagcggtttgttctgtgctgattgcgattgtctccatcatatggcaggggaatgcgcttttgggatttgttgtcgcctcttcactgttcttaaccttaatcatcggcacgatgtcaggaacgattatccctattattttacacaaactgaaagtagacccggcaattgcttctggaccgctgattacaacgttaaacgatattttatctttattaatctactttggcattgccactgcattcattcactctttataaacgtaaaaagtccgtctcaactgcgagccggacttttattatttaacggtttttgtaccgaaagtgagcattaagctgcccctccagcatttttttccgcacttgcggatcgttttttaacatctgttcttttttgcgcatatcctttaaaatctctgccgtctgtacgccgtcttcacgtttattggcgatatccatcagccgctctacatcagcaaaggagtattttcttgtcccccttgaagaacgctgcgggtaaatgagctttcgttcctcataatacctgatctgtcttacggacaatcctgtcaattcactcacaattccgattgaaatcacttttttgtctttataagaatgatcttctgtggtcatttttccacccctggatgtcttttgataatagtatataaaaaacaaagagaaaaaacctgacgcttgtcatattttctaacatcaaatagaagatttttgaaaaaatacggaagaaaaattaacaagaataatgcgtaacacccaagcgcgttttatcctttatgtaacgaatcaaacgaggaggaaggataatcatggaggaagaaaaagcggtctcactggcaaaagaaattatagagttggatatcaagcgtgatgaaatgctggagacgtttatgcagcttgccggagaacaggcttttcaattattaagatcggttcaaaacggacaataccgaaaatcttcgtaaacataaattctttacattagattcataccacgttcatttaaaaagagtatcttttgtataggatacctcaaaatgaaggaggacgctatgagtaatttattgaaatccgctttagaaaaagaacgacgccattattctgaaaaactctatcagattggggtttataataaagaggtcatgaacaaaatgacgatttctgagcttcggaaagaatacgcttatttctttcgaagcattacaaatcataaaaattatccttatacaagataatgtataaggatttttttgcttttagaaggaatttctcgaattatagcgaatacgtatagtaagggactgaactcttattatatgtaagggttttcattatttttttataaaaatcctatatacgaggtagatatgatgagattatcgtttaacgaagaagaagttgagcgtgcgatgaatttgtacagagtttttgcaagggctttcaaaagtgtgtccgaacatagtatccgtgatagcaaagagcacggttttaatcccactgaatttgctgtactggagctcctgtacacaagaggcccgcaaaaattacagcaaattgggtcgagacttctgcttgtaagcggaaacgtcacatatgttattgacaaactagaaagaaacgggtttttagtaagggagcaggacccaaaagataaacgctctgtttacgcacatttaactgacaagggaaatgagtatttggataaaatttatccgattcatgcactgcgtattgcgagagcgttttcaggtctttcgcctgatgaacaggaccagctgatcgtcctgctcaagaaagcaggcatacacagccagcatttgctgtttcgttaactattctacactctctatttcaggagagtgtttttttgtttccatatgactctttttaaaacatcttcaatcttcctatcagacatttcgccaaggtatccattgacgtgttttttatactccttcatctgttcgttcgattgaaaaaataccgcgatatactcttctgctttctgcatgtcccagtttctcatatctgttacgagcttcctttcatgtagaaggtttaaattcatttcctcctgtcccggcagtgcatgataaataaataccggaagccgttactgtaagcattcactgatggtcacgcctccgggtttagtcatgatgcctgtcgcctgttcgtacaaacggttcatctctgctttgctgtgaaggtaaggaatcgcctcaatcaaggggtggtgtaaacttttgacataggagtagagcttttcgtttctgccgcataatattttgtataagatctttccgcctggcgacagttcctgcacccattttaaaatcccaccgacccccatactgccccctgtgatgatgatggtatatggcgggtggtgctgcaaggtatctgctgattccatttcaaaatttcggtgaactggaatgccggtcaagtatatgttgttctgatcgatcccctctgatattagctgcttctttacttccgtgctcggaacaaaatggtaatcaatgttcttccgtccccataattgattcacgaaaaaatcagtgtatacattcactaccgtcagattcggatattcaggctttagtcggttcagcagataagaaggcagcgcatgtgtgcagaaggcgatatcaggctgtttttcttggaggatgtgcctcatttgctgtgtgaacagccattcgtacatgaaatagcgtttgtcatgctgaaattctccgcaggcgaggagcctgtaaatgccgctgtacgttttcgggaaatattgaatccattttaaataagccacggaggacaatttttctaaacggctatacgcatgtgaaaagatatcaatcttttcagctgccagcccttgagactctaattcagcctgcaatgcatcagccacatgatgatggccggtggaaatgcttaaaaaaggaaaaatgagaatgtttttcatgacagtcctcctaaaaaaatatggcaactatattttgaggagaacgttcacaaaatataagggtgtttttgatcataaggaaggtgaaaagatgaaaacttgtttcctttccatatggagagtggttgacccgatttatttctttttttcaaggctaagcttgattgacaacgatcaaaaaagcgtttttcgagtcaggctgacgaagtataaaggacatcatgtcgtactgagcgatggaacgcatattagaaaaaatgatgtgctcgttaaaattcatctgcacaatattaagctgataagagaactgcaaagcattgagagcgcggtcagaaaaggaatcattatttatcagaaagtatatcaatcgatgccgcttcttcttgactatatcaacaatcataaaaaaagcgagaaaattaaaggaatcattgggattacaatgcttgacaaaggtgtggaaaggctcggctttgatgtgatcaccccggtgaaccctttttacagatgctttaaaaaagtgtcccatgtgccgattttatatttgacttcaaagcctgtgagcttgcggcatttaccgaattcatcctatttgtttatctcaaaagaaaagctgcagaaaacctatcaaaaaaaagactgatgcctcggtcagcacagtcttttttgattaaatctgatgaaatgttacttcagggcggcttccgacacggatatttacgccggtttgtcccaagccctcgctgatataaaatggtttatcgtaatgataatgaaggcctttaatcatgttcattcgcacgagcttgcccattttcaccaaatgatacggttttggccagtgaatttgcccgccgtgaaaatgccctgacagcaggtaatcataatgaacatctttcatatccagaataatatttgggtcatgtgttaagacaagatgatagccattttccagactttgataagagccggtgatattactccgattcgtactgtaatcatcaatgccgataatattgactggccctgcagccgtctcgattcgaacatgttcattttgcagcgtaatacagccgttttcctctaaaactcgctttaatctccgaaagtcctcttctttcaatacataatcgtggttaccgaacaccgcgtacattccatatgcaggcttcagcttttgcaaggcgttcaagtaacctgccagcttcggaatattacgtttccgatcaagaaaatccccggtaagagcaatgatgtccacaggctgatcttttgttaaatgatacagctcctcaggtgagacagaaatgttttccaagtgaagatctgataaatgaaggatatttaatttttttctggctggaaggccgtctttttggtcgattgaaatggtgttgactttcacatcttttgtattgcggttcgctttatatagaaatggcacaaatacgagtatggccaatgaaagtaagattgtaaacaaaatatatcccctcccttctatcagtatagtaagtgatcaagccctatggatagcgggaattaatgggtagagacaggctgaaaaacggattgtcatatgatgaatgatttggaagggaaaagggataataaattttgacacatgaggcagaacatgccgatggagtcagaataacaaatggatgtgtaagcaatgttacgattgatgagacaacaaaaaaaagaaacatattatctctggatcgcattatttcttcttttattgtatgtatccccgctttttattttaaaggaagatgcccatatccgggtccacgataatttagattccaacatcgcttggtacaaggttctggccgatagcggagaaatcgtcggcaaggttgacgctgccattccccaaatcattaacgggctgccccgggatgcctttggcaccgagtggagcggaattgtttggctccatgctttcttttcttccatgaccgcctatgcaataagccagacggttacaagagttgtcgctttttttggaatgtatgtgctgctgaagaaacatataatcccggaaccaaaagcggctttcatccgaattggcgtatcgcttgcatttgccttaacaccgttctggccttcgggaatgctgagtacgcttgggtaccctttggcactgtgggcttttttaaatatccgaaaaggggatatctcatggagagagtggctgacgctgggcttgcttcctctatactcaagctttgttctaggcttcttctttttcctgacagggatggcgtgtttttggctgtatgatgccattacaaatagaagatggaatttgatgttcttaggcagtattgcatttatgacgagtatttatcttttcgttgaatatcggcttgtctattcgatgctgtttgaacacgcaccgatgcatcgtatcgaatttatctcatccaggcatgacgtttggcagtctcttcggctatccgtaaaaaactttgtctatggccataatcatgtgatgaccgttcataccgttgtcatcctcccgatcctgctggtcgtatttgctgctctgctgttcaaacgaaatcggacaaagccagaaaatgtttatctgtttttatgtgtgcttaattacgggttgtcattatggtatgcgttttggttcaacaaaatttgggctgttccaaagcagaaatttgcttttttagcagaatttaattttgcccgttttcattttcttcggccgcttgttatatacgtgagctttgcgcttgctttatatctcatttggcggatggggaaaggatggaaatggcttgtgtacgccgcagtcgctgcacagctgatggtgttggcgccttttaatgaagaatatacgtatggcgttcattacaacgcgccgacattcaaggagttttatgcatcggaacaattcaaagagattaaggaatatatcggacgtccgcaagattcgtacagggtggcgagcatcggactgcatccgtctatcgcccaatataacgggttttatacgttagatacgtataacaatctgtatccgctctcatataaatatgaatttaggaaaatcatcgaaaaagagctggaaaaaaattctcggctgaaacaatactttgatgaatggggcagccgctgctacctttttgtcgatgaactcggtaaacgatatgatttcaaaaagaactcgaagaaaacgatcaacaaccttcaattaaatacagatgtatttaaaaaaatgggcggacggtacattttttcttcagttccgatcatgaatgctgaacaaaaccatctcgcgctcgtaaagacgtttgaccataaagattccgcctggcgcatttatttatatgaaacaagataaggaggatatcgattgaaacagtcacagccagtattaaccatcgtcgtcccgtgtttcaatgaagaggaagtgtttcaagaaacaagccgtcagctgacagaggttgtagatgatttaattgaagaaaaattaattgctgaagacagtaaaattctgtttgtcgatgatggcagcaaagaccgcacttgggctttgattgctatggagagcataagaaacaagaaggttaccggcttaaaattagcctgcaatgtcggccaccaaaaagcgcttttagccggactgcataaagcgaagaataggtcagactgcgtcatttcgatcgatgctgatcttcaggacgacatctctgtgatccgggattttatgctgaaatatcatgagggctgcgagatcgtttacggtgtacgccggagcagaaaaaccgatacctttttcaagcgcacgaccgcgttagggttttatcgtctcatgaataagcttgggattaaattaatttataatcatgctgattttcgtttaatgaataaaaggtccctcgaagagcttgagcgttatccggaagcgaatctgtttttaagaggtattgtccctatgatcggctttaaatcggccgaagttttgtatgaccgcaaggaacgctttgctggcaaaacgaaatatccgctgaaaaagatgctatccttcgcttttaacgggattacttcattcagtgtcgcaccaattcgattctttacgcttttagggtttgttttgtttttcctcagcgctgtggcagggattggcgcgtttattcaaaagctgctcggccatacgaatgcaggctgggcgtctctcatcatatccatttggtttttgggcgggttgcaattgatgggaattggcatcatcggagagtatattggaacgattttttctgaagtgaaaagacggccgaaatacgcgattgatattgatttgtataatgagcagctgagcccgctccagcgccaggaaaaagagcggttagaaaaaaagtacagttaaacggaaagagctgacttcattagtcagctctttttctttaactgatgcaatatggcgctaagcggttcgtcttgcgggttgcggtaaaaatcaaaaaatgggcagccctgcttcttaattcgatcgatgaccgtatcaattgtaaacagagcgggtgttaaagatgattgcacctcatgccagtagagcggggctgcgacagtcccaagctcatttcctctcgtcgaatagggacagataatcgtttttccttctgcgtgctgcaaataatcaagatacaatttgccgtgtctgtttttaatcaagcgttcagtggtaaagagctcgggaaatgcattggtgcagtactctgcgatcagctgtgtaaattggcgtgtttcttcatacgtaaatgcctcgggagacaagggaatataaagctggatgcctttgttgccggacagcttcgggtacgatgtgatgccaaaggaatccaacagccgcttcagttcatttgcggcctgcacggccataagaaagtcatctcgcgaaggagggtctaaatcaatgacaatctcagccggacgcctgcttttaatggtttgaaaaggaacgtgaaactccaaagcaagctggttgcaaagccatagcaatgtagacatatcctcacagacaatatgttcatggcttccatcatagaaagattgaacaaaatccggcgcatagtccggcttgtttttttggaaaaatgattcgctcctagatccatgcggatagcggatgacggtgacagcccggtttttcagaaatgggagcagatagtcactgacttcaatcatatactgaataaaatcttcttttgtttttttattcttttcaaatatgattttatctaggcttgtgaactggagctttgggtgaaccggtttggagtgtcgtatgacttgcgcatacgtgcattcggtccagtccatttggaattcgaaaccgataaacgatacctctcttaatgtgccttggagaattgttaagtattgaacagatgcacaaatcgaaggttcaagactaaattcgcctgagggtgtttgatgtccgtgctgttccataatctcgcgtatagcgcttttttcctcatcgcgcattccgtgcgagacagaggcaatcggtgtcattattccgttttttaacacagataccgtcagaaacccgttgttagggttgaaccctgttatgcaaacataagcttgtttaaagtttttatatttgagccaatcggacgaccgcttcttttcaagccatttgctgtttgttttcttcgctacaattccttctccgtcatattttattaccatctcccagagttgatcaaaatgatcataacagggaatggattgaatggtttcttttgcgtaaggatctggagatgcaggaagctttgctgcggatatgagttcacgcagcgattttttgcggtctaaatacgaaagaagcgttacatcttctccgcttcgctctaacaaatcaaaggcgagaaagcagcacggccgcgcgtgtgccgattcctgaatcttgtctggccttttcaaacgcccccgcacttgaaggtgttcaaaatctgcacgacagggattcaccaaacatacgatttcaccgtcaagtgtcagcggaagctctttttctaggtgctgaaaggcagttttggcgaattgtgtgatttcagggaaggtgctgctgagctccacaccatttctgctggttaaggtcacacctgaagaatagatgcggagaatacagcggtacccatcatattttacttcgtaacgccattctgctccgattggcggtgacgaagttaagaccggctgcatggtaaacgccatgcgctatgatgtgccggaggctttttttctagttgttttttgttttttatctccggctcctttcggttcagcggcttgtgcaggtgcggcagccggtgtctcccggttcggccttctggttctgtcgatgctggcttgcagagcgcttaccaggtcaatgacatcttcacgaggtggcgctttatcaggagtcacagccgtttctttattttctagcttgtcgttgactctttgcagcagcgcctgtcggtacgtgtcttcatatttctcaggctcaaactcagcagtcagttcatctattaatgtgatagcagtttgcagttccttatcgtttacattcgattgatcaggtacacctgggacatgagcggcgcttctgacctcatcgggataatggatagactccatgacgatacaattttcataaacacggagaatcgccagctgctgctttgacctgattgtcatattggcgataccgatctttccggttgagcgcagcgcctcacgcagcagggtataggccttcgtcccattatccccggggccgacaaagtaggagcggttaaaataaatcggatcaatttcctgaagctgaacaaagtcaacaatctcaactgctttctcctcatgctcctgttttaagctttttaaatcttcgtccgtcagcactacatattttccttttacatattcatatcccttcacaatttcatcaggactaagagttttttcgcaatttgtgcaaactttctcgtatttgattggtgcgtgatcctctttatggaggctgcgcagtttaatatctttatcttctgtggccgcatatagcttgatggggatgtttactaatccgaagctgatcgatcccttccacattgtatgcatatcgataaaccccttttttctttagtgtgaagagaaggattacgattcatgtgtagtaacttatgggtgaaaaaaagccggcgctgttattgcgacggctgttcaataatgaattgttcgaattgttccggaggtattggcctgctgaaaaagaagccctgtaaatggtcgcagcctttttcaaaaagaagctgcttttgagctgcattttccacaccttcggcaatcacctgcaaagacagctgatgccccatggcaataatagctccggtaatttgctctgatttaggatgggtctgaatatcgtcaataaatgatttgtcaatcttcagcctgtgaatcgggaagtccttcaaatagctaagagagctgtgaccagtaccgaaatcgtcaatactgattctgattcctaattctgttagggatgataaaacctttttggagtgatcgagattgtccattgtcatgctttccgtcacctccacttcaagaagctgcggggaagctggtatttattaagcgtatccttgatgaggggaatcagatctttggattggaactgtctggcggaaatattaatggcgacagaaagatcatagcctttgtcatgccaaatccttgcctgcttgcatgcttcatctataatccactttccgatatcaataataagtcccgtttcttctgcaacaccaatgaattctccgggcggacgcagctgcccgtctggtgtcacaaggcgtatcagtgcttctgctcctgtcattttttgtttttttacactgaattgcggctgataatgcaacacaaatctatcgttttcgattgcttctctgagtaccatctcttggttaagcttgacggtttctttgttgccgattgaaaaagaatagtatctgtatttgcttttgtttcgttctttagccgcatacattgccatatcagcctttttcatcaattcaagtccatccgtcccgtcttttggagatatcgcaatcccgatactgacagatgtgacaaggatgtgatcttgaattttgaaaggttttttgaatttttggataatttttcttgccaaaacatctgcttcgcctgttcctgtattggcgtctgttaatataataataaattcatcaccgccaagacgggcgataaatccgttatcagggactacagatgacaggcgtttagctgcaaactgaagcagttgatcaccgacattatgccctaatgcatcgttaatcactttaaaccggtttaagtcgagaaagaatacaacggtgttataatgcaaggaatgctcgcgattcagcacctttgttagatgagagatggcatgccttctgttaggtaagtctgtaagtgaatcataatgagccattctatggatttctttttctgctttgtactgcttcgtcatgtctttgcaaatgacataaatgctgtctagttcctgattgacctcaacaggtataagcgtaatatttaagtggaactggcctttttcagtgataagatcgctatcgctgttcatcgcttgtttatcttttttaacttgctcaaaaaggcgcttaatcttctgtgatgtataattcctccagtcatgcatgctgaagccaaatttgctgatcatttcctcaccagcgtgattggaagatattatgtctccttctaatgataaaataaagattgcatcaatattgtggacaattaaagactgaaatcgttgttcgttatcctttatgcgttcgctctgtttaataaattttcgatctgcatgggaactgaataacaataacgtttggatacaaaaaataattaaagtaacaaaaattgaccaatgaaacgtttgcacctccatatggcttccgggcggagccatgttcttatggaaagttgccgcaagcatccctgtgtagtgcatgcccgaaatcccaatacccattacaattgaactgacgactttatagattataagatgctcagaatgttttttcacggccaagtcaaagaatatttttaacgagacgaaagaggctgcgatcgcaatgataattgaaactgtaaataaaatcggttcgtaaataatcattacccgggaaatggcagacattccgatatagtgcatagaagcaatagatgcgccaagcacaactgatccgataagcagtctgtaatatgtaagaatgtgccggctgacaaaatataatgacacaaatgatcccgaaacagatgcgccaatggctgccattaaaggcatgaattcatattccatcggcatttccatatggacggccatcatccctacaaaatgcattgaccaaataccgaatcccataataagtgagccgccgatcagccaaattttactttttaagcctgtgttgatggtgactttcctggaaagttcaagggaaatatacgaggcggtacaggcaattagaatagataaacatatgagcgtcgtattatatgtaacgtgtatttccaaatggagattcccccgtatcgtgtgttccagtcttgttgactctctttattatcggctgcttaaccgcagagtttcagccttcaaaacgatagaaatacgagggagatctatttttagttcaactgaccgtgaaaaatgtgttaaaatcatcttgacgttttccgaaaaaacaaaaatgtatgatacataaacatgagacaagggagttggtggctatcgaagagctggttatgtcatggatagaagcatttaaaagcttatcttattttggaatatttctagcgctcagcattgagtttattccagccgaagtcgtcttgccgcttgcgggctattgggtatctaaaggcgatatgacacttgccggcgttgttttggcaggatcgcttggaggagtggccggtccgcttacgctgtattggataggccggtacggaggaaggccgtttcttgaacgttttgggaagtatctctttattaaacctgaagcgcttgataagtcagataattttttcaaaaaacatgggggctttgtcgccttcagcggccgtttcttgcctggcatcaggacattgatttccataccgtgcggaattgcaaaaatgaatgtttgggtgttttcgctttatacattcattgctatgcttccgattacatttgtatatgtttatctcggtgtgaagctcggtgaaaattggaaggaagtcggctctattcttgatcaatatatgcttccgatcgggatagcgattttggcgctgttcctgctctacttactgatgaaaaagaggaagaaacgcacgcattccgaacaattatctgtatttttaaaaaataagcgttgacaaatcattgcgctgcgcatatcattgacgtataaaatcatatttcttgaaatcccaaaggggagtagcgtccggaatgtattccggaaacaaagtcgtcatttcatggattgtatccatcggctttgttggcatgcctgaattcatgtctagcaagacctttgccttatgtcggcaaaggtcttttttgcatggtccggccggcataagatcggatgaagagaaagaaaacaacttttttgggagggtatcgtttatggatgcagcattattattagagtatggttgggttcttctcgtcttgatcgggctggaagggattttagccgccgataacgcgctggttatggcggtaatggtaaaacatttgccggaggaaaaaagaaaaaaagcgttattttatggattggcaggggcttttgttctgcgatttggctctttattcgccatttcatttttggtcaacgtatggcaggttcaagcgattggcgcgatctatttgctgtatatctcagcaagccacttattgaaaagatatgtatttaagaaagaagatacacataaagagacgaagcaaagcggtttttggccgactgttttaaaagttgaactggcagatatcgcgtttgctgttgattccatcttagcagcagtagcgctggcggttacacttcctgggacatcactcccgaagatcggcggacttgacggaggacaatttctcgtcattttggccggcggtatcatcggactggtgatcatgcggtttgcggcttccatgtttgtgaagttattaaaggaacgtccaagcctagaaacagcagcctttgtgattgtcggctgggtcggagtgaagcttgctttatatacgcttgcccatcgcgacatagcggttgtttctgagcactttattcattctggaacatggaagctgatattctggggtgtcttagcagcaatcgcggtttgcggctggtttatgtcaggtgggaaaaaacagccggagggcgcacaaaacgagcaaaaaaacagcacccgtgaacgggcgtaatctgaaagactctgcttaaaagcagagtctttttgtgtttgaagcgttttcataagcgaaataaaataacatttttataacatctttgttacaaaaaacacgcataaaacccccttaattctttagaaaggcacgaaatcatgtataggacgtcagaatggtttgtcataattgagacattggaaatcaatatttctttttctcctttgcgaatccctatcaaattagctatcattaatgagtagttatagggaggaactgaggtgaaaccagtgcttagccttttgtttaaattgggaaaaaagaagcaaacacttgaaaaagctgttgagagtatacaaaaaggcaataaagatctgcaaaatgaattaatacagcaatataagccatttatcgcaaagacggtttcatccgtttgtaaacgatatatagatgaaaaagacgatgagttcagtattggactgatcgcgtttaatgaagctatagaaaaatattcacctgaaaaaggaaattctctgctcgcatttgctgagcttattataaaaagaaaagtcattgattacattagaaaagaagccagaagcgcacaaaatataaatattgatttacaggaaggagacgatcaggagtcatcacaaagcctgattgaagccgagctttccattgatgaataccgccgtcagattgaacaggagcagaggcgggaggaaatcctctattttcaaaagcagctcaaggattatggtttatcgtttaaagaactgcttgaaaattctccaaagcacacggatgcaaggcaaaacgccataaaggtggcaatgacgcttgttgaacatgaagaattggccgctatcctgtatacaaagaagcagcttccggtcaaacagcttgaacagcttgtctctgtaagccgaaaaacgattgagagaaacagaaaatatattattgcgatgtgtattatcattacgggtgattatatttatttaaaagattatcttaaaggggtgctgcactcatgagaagagggattatagtagagaaaaataaaaaattcgtcacgttgctgacccctgacggacaatttttaaaagccaaaaatgatcgacacagctatgaaatcggtgaagaaatcatgcttccgagtgaaacacgcatgggcagaagggccagcttttttgatttttttaaactgcgccctttcaaaatggggatttttacgatgactgctattatgctttttatttttatagttctccccgttttttctaataataaggcctatgcgtatatgacaatcgatatcaatccaagcgtcgaaatggcgttaaacagcgattatgaagtgattgaactgacacctctaaacgatgagggacagaaagtcgtgaatgatatagatgattgggagaagactgattttaaaaaggtgattgacgatattataaccgactgcagtgaacacgggtatgtaaagaagtcgaaagaaatattgatttccactgtttatgaaaacacagaagacaatacatataaaaaggctgtgaaaaaacagctgaatgatgtgactgaaaaatataaaacgacataccgcatggaatctctcgagtcagatatgcaaacgagggaaaaagcgaagaaagaaggcgtctcaacaggcagctacatcaaatcaaatgaaaagaatgacaataaagatttaaaagatgactccagcaaaccatccggggaagaggatcaaaagagtgatgaaaatgaggctgaaaacaccgatcaaactgacacccaggacagcaagcaaggagataatgaacagctgaatgatgcggattccggagaccagaaagaagataaagcggatgaccagattgatgatagtgacaaagataaaaaaataaaggaatcagatgaaaacacaaataccgaaaaagatggggaccatgagcaaaccccaatacaagatcctcaagataaaggaaatgaaaataacggcgctgacaagggccaaagccaatatcacagagactggaacaatggtgaacaaggcaagaaccgttcttcgtccagaagggataacgcttcagaccgacgtaatccaaacggctacagcagtgataataattcagctcaaaatgaagattcgccgagtgcccccggcgaataaagacctgaatttatttagttgtgccatttaattgtgattgtgcttgctgtaccagccgctttgtcatttctccgcctacagagccgttagcgcgtgcgactgtatcagaaccaaggttcacaccgaattcttgagccacttcgagtttaaattggtctagtgcctgctccacccctggaacaacgagtttatttctgctcgccatctttttcatctcctttttcgataaagaaattcttaacgcgtatttagtttgaaatatacggggtttatttatgctggcaattgttgtggagaaaaataaaaccccggcctctgagccggggtggcgcagactatagaatgtctgctgtcattttatgtgcggttgcctgaatatggaatgtcaaaatggagaggactgtaatggcgataatctgtctgattttaagccattggctgtcattcagttcttcaaaacggtgacggagacgctctgtctcctgttcggcgatctcctgcagatttgattctttcatggaaggagtatcttggtgatggatggcatcaagcacatatgcgcagctttcataataagcaatcgggctgatgacatcatcagatctgtctgagattgtgttaaaggccacttttaaaatagcccgtatgtgttcaaagtcataaatggattttaaatcacgtacaattaaaagaataactgcctgttcaattgagtattttttgcccagctcagggtgtccgatcagatctttgatatcacgctttacccagttttgaatcgcggttgactttaacgaagtcagctcgcataagttgccaagctctacgatttcatttgtagacagaccgtattcttttttctgtttttttcgttcgtatcttgtaagaaattcaggaatttctagatgattggctgctttttctgctgacatgttcgctgattggacgagaatgtcgagcgggctatgttctccttgtccttttagggaatagagcagccgcaccatatcggttcgagagagtttaaaaatgttcattgttcacctctttaaacaatttgacgcggatataggtctatgtataagttcaaaattcaagcgtcagcaaattacattaacatcatacgtcgaattccttgcattttcaaatggatgttttataatttaaatatacgagttcttttgaacttaaaataacggaggttgttatggcgaaaagaatttttctgtttattctaacgaatattttggtgcttacaacaatcgggatcgttttgtctgttttaagctctgttacaggagtcgggacgtactttacagctgatggcggtatcgatccaatggcgcttcttgtgttcagtttagtcgttggatttgtcggttcctttacgtcttttgcgatgtccagatggatggcaaagacgatgatgggcgtcagagtgctgaatccgaaaaaacactcgctcagctatgaggaacagcaattggttgatcgtgttcacagattaagccgctctgccggtttaacgaaaatgccggaagtcgggatttaccgttcacctgaagtaaacgcgtttgcgactggaccgtcaaaacgccgttcacttgtcgcagtatcgtcagggctgctggatcagatggatgacgcagcggttgaaggtgtgcttgcccacgaggtcgcgcatatcacaaatggtgatatggtaacaatgacgcttttacaaggtatcgtgaatacctttgtcgtctttttatcgcgtatcgccgcttggatagcaagccgttttgtcaaagaagatctagcgccgatcgttcattttattgcaatgattatttttcagattgtcttttcgatacttggcagcctggttgtgtttgcgtattcacgccatcgtgaattccatgctgacagaggaggagcggatcttgccggcaaggacaagatgattcatgcgctacggacgcttaaaagctattcttcccggattatggaagacgatcagacagctgtccaaacgttaaagattaatggcaagaagcgctcttcacttttctctactcaccctgatttagatgagcgaatcagacggctggaagctaaataatacaaacacattgttcctctgagagaattctcagaggttttttattttatccattgactaaaatcataaaaaaataagcaagttaagaaaatgtttcgtaaaagcctttaaaaatggacctaatatctttagaataattaccgtacttaaaaagagaggcagaaggattttacatgagattaaagtttggaaaattgatacaggccttgtcaccggcccagctgatcgcattatattattttcttgctgttactgtggccgttatattgctgagtttgccggcggcccataaaccggggcggattgggcgtttattgatgcgctttttacagctgtcagttcagtcagtgtaacggggctgacggttgttgatacagctgatacattcagcacaatagggatttttatattagcatttgttctgcaatttggcggaatcggaattatgacgctcggaacgttcatttggctgatcatgggaaaacgaatcgggctgaaagaacggaaactgattatggttgatcaaaaccaatcccagttttcaggaattgtcaatctgatgaagcaagtactgtttctgatcttgtggattgaattttttggcgggctgatactcggcacatatttcttaacctactatgactcctatcaggaagcttatttacacggattttttgccagtatcagtgcaacgacaaacggcggatttgatattaccggtaattcgatgattccatttcgccacgattattttgtgcagtttattacaatgcttttaattatatttggagcgattggatttcccgtgcttgttgaagtaaaggatttcctgttttcaaagcatcggcgttatccatttacgctttttacaaagatcacgacgattacattcggctcacttgtcttgtttggagccattggcatctttgccctggaagcaaaccatgcgttcgcaggaaaatcatggcatgatattttgtttttgtccctgtttcaatcaacggcaacccgaagcgggggactggcaacaatcgatatcagccaattatcagattccacactcttttttatttgtgcgctgatgtttatcggagcatcgccaagctcagttgggggaggcatacggacaacgacttttgctttgaaccttcttgcgctgtttcattttgcccgcggcaataaggccgtaaaggtattcaaacgggagcttcaccctgctgacttgatgaagtcgcttgttgtcacgatgatggcgatcctgctcgtttttggcgcgaccctcattctgaccattacagaaaagcattccctgctggagcttttgtttgaagtgtgctcggcattcggtacaaccggcctgtcgcttggaattacggcagatttgagcagtgttggaaaatgtgtcattatgattgtcatgtttatcgggcgaatcggcatcctgaccttcctgtatctgatcggaagaaaggaaattgaagcgaattatcactatccaaaggaaagagtgattatcggataggcaaaacaccgcatattttgcggtgttttttgattgccaaaaaaaagatgtgtgcctcctgttcagttggagaacctaacttcgacaggtgcaattaacgctcctgcatcttgaagtgagtaaaatgtctgaaaactggcgaggaggattcgtatgaagcgtaaagctgaagtgaatgaagccattaaaaataacaatacacctaccgagagcatggaccccaattcatataagacacaatatcatgacgaccccaattttagaggggcaaaccgcaattccaaacagggccagcagggaggcatgtaattgtgaagaaaaaccgtcatagcagagacatgcaaaatcataaaaagcctatgaataaaaaggtgctggaggaagaattctcaagtgaacttggggattacaatgccggaaagatcatcgaaacgctggaagtcactaagcctgaaaagaaaaaagaaaaaaacaaaaataaaaaacaacaataaaaaagacctcttaggcggcgtccgcttaagaggtgcttttctattttaaataagcatttttgcccgttcctctgacaaattgcaataagctggtcatcctcagctcaatgaagggctgagcgactgtcttaacaaagttgctggagaggactgatgtaagggctgctgttaaaagcaagaggatcactaagctttgatagtcagtaagccaatcctcaagcccgacctgccgtaatgttttaataataaacccgtgaagcagatacacgtaaaatgtccgggttccccatctggtaaagaaataccgtttttgcggaacaagcgctaaaaagctgaaggttgccccaaaggcgagtacataccagccgattcgggatagtccgcttacaagggtaacgtctccaaatgaagaatacggttttgaaccaaacagaaaagaatagtcaaaatcgatgccccagcagatgacgaatactgcggaaagcactccgagcgcaatttgtttgccgcgttttgatctcaatagatcaaaatgatgtttatttaaataaaaaccgacaaggaacatcggtaagaatacgaatgtccgtgacaagctcagcgtgctgctgacaaagtccagataaccgatcagcacggcgattccgcagctgacaaacagcgcccactgctttgaaagctttgaaaaaggatataggagcaggttccaaaagaataagcttacaagaaaccataacgaccattgcggatcaatcgggttcacatttgccatgctttcatcttgcataatgtaataaaagacggaataaatgatttggaaaatcaaatacggaataatcagcttgaccgccagcttttttacatatcccgcccgtttaaagcctttcgcgaaataaccggatacaagaataaatgcaggcatatggaatgtgtaaatgaacttgtagaggtagagcataaaatgattatcattaataaaggaacgaaggatatgaccgaatacaacaaggaatatcaataaaaattttgcgttatcgaaataactgtcccgcgatttactcatagcatcaccttctctttcatcagtcactaagagattattccctgctggtacatattttaaaataaaagatgaaaaaggaatctaaaaaaatgctgattgttaggtcgatgtaaagtgacggtaaggatcgtagaaaatgtcttcgtaatgtaatggcgctgaaattttctgaaatttatagggcaaatgaaggaagttcccgcattttgtagaaatattgagggataggttttgaagaaggagtgtacatgcatggaaactcttggtgtccagacaaactcggagctgcgagaggaactgaatcgcctcaaagaagaaaacgcgcgactgaaaaaggaattgaatcagcatcaagtgattgtcaacaatacgctcgatgctatttttatttgtgataacgaaatgcggattgttcaggcaaatgaagcaacagaaaggatgcttcaagttgactcggaagatttgaaaaagcgttctgttttggattttttgttttcaatcccaaaggatgaactgaatctttccgtaaagaagttttttaaaaaaggctttctgtggaaggaggttccggtcaggcttgattgcggggcaacaaaatacatagagtttctggccaaaagaggcattggtgaggatttcttttttgttgtcatgagggacatatcttctaagaagattctggagcgggaattctctatgaatgaacagctttttaaggacttgtttgacagagcagttgacggaatcgtcctgtttgataaagatggcggttttattgatgccaatttgtccttttgtaaaagctttgaaatcaatcataatgagctgtctcatttatcgttgtatgagttcatagacagcggctcacgaaaagatttcgacaatatctggaaggcgctcaaccgcaagggaaaagcgaagggggagctgcctgtcaagcttcgttcaggagttcaaaaactatttgaattcacgattacatcaaacatcatcagcggtttttatatgtccattatgagggatatcacagagaagcggtctatggagctgcagctctttaaaagtgaggagcgcttcagagaaatctttgaaaatgcaatggacgccatcatcatctggtcgaatgacggaagaatcgtaaaagcgaatcaatcagcctgtaaaatttttgagctgccgatgaatttgctgttgaaaagaaagctgtgtgattttctcgttgactcgcagcagaaatacagcataacgaaaaggaaatacgcaaaatacggagagatcagagaagagctgctgtttcaaatggggaacgggcaattcaaagagcttgaatttacttcaaaacggacaatccttgaaaatcagcatttgacgatcttaagaaatgtaagcgacagaaagcggatggaaaaggagcttcgggaaagcgagctgaaattcagaaaagtgttcaacggctcaatggacggcaatgtattgttcgacaatcaatacaggatcatcgacgccaacccattagcaagccatattttgggactgtcacatgaagagatcaaacagcacagcctgttagatattatttctgcttatgaaatagaaaatctggcatcaccagcaaggcagattaattttgatgaaatggacaacgaaattccatttttgctgagcagcggtgataacagaaaactcgaattctcatttaaacggaatattattcaaaatatgaacttggctatctttaaagacgtaacagagcgaaaagaattggaggaacgcctgcgcaaatcagatacccttcatgttgtcggcgaacttgcagccggcattgctcatgaaatcagaaatccgatgactgctcttaaaggcttcattcagcttctgaaagggagtgtcgagggagactacgccctttacttcaacgtgatcacctcagaactaaagcgcatcgaatccatcatcaccgaattcttgattttagctaagccccaggccattatgtatgaggaaaaacatgttacccaaattatgagggacacgatagaccttctaaatgcgcaagccaatctcagcaatgtacaaatgcaacttgatttaattgacgacattcccccgatttactgtgaaccgaatcagctgaaacaggtttttatcaatatattaaaaaacgccatcgaagtgatgcctgacggcggaaatatttttgtaacgataaaggcattggatcaagatcatgttcttatctccttaaaagacgagggaatcggaatgacagaagataaattaaagcgacttggtgaaccgttttatacgacaaaggaacggggaactggactcgggcttatggtaagctataaaattattgaagaacatcaaggcgagattatggtagaaagtgaagaagggaagggcaccgttttccatattacgcttcctgtcagacagaatgctgaagaaagaaggaatgatgaatgaactactatacgacagccgaaacgccgctcggtgaacttatcattgccgaagaggaggaccggatcactcgtctatttctcagtcaggaagattgggtggattggaaagaaacggttcagaatactgagcacaaggaaacacctaatcttgcagaagcgaaacaacagcttcaagaatatttcgtaggcgaaaggaagacattctccctgccgctcagccaaaagggcactccttttcagcaaaaagtgtggcaggcgctggagaggattccatatggcgaatcccgaagctatgcggatattgccgctgcggtcggcagtccgaaagcggtgcgcgctgtcggacaggctaataaacgtaacgacctgccgatttttgtcccgtgccacagagtgatcggcaaaaaccgtgcgttaacaggatacgccggaagcaaaacggagatcaaagcatttttgctaaacatcgagcgaatctcctataaagaaaaataaaacatatggcacgttccctttttttcacggccgacatatcattttattaagttaaaaaagttggtctgatgaaaaaggaggacaaagcaattgaagccgagccgctctgagaaacttgccgtttttgccgaactgtttgtgaaactgcatatcttatcaagcgctcaaaaagatgaaatcatcaatgttaacaaaaagaaacaaaaaaaccgctgactcggctccaaatgagcaaagtccggcggttttttaatgcaccttttctcctctaaacagctgttcaatctcttcttcatagtttccggtcataatccctttttctgtgatgattcctgaaatgagatcatgaggtgtaatgtcgaaagcgggattaaagacaggcacattggatggagcggtccgaactccggaaatctgcctgacttcctcgggatcccgttcctctatcgggatatcagcgccgcatttgacctttgtatcaaatgtagataaaggtgcggcgacaaaaaacggaatatcaaaggcgtttgctaaaatagcaagaccgtatgtgccgattttatttgccgtatcaccgttctttgcaattcggtcggctccgacgataacagcggaaatttgtttttccttcatcgtatgggcggccatgctgtctgtgatcagagtgacatcaatgcccccctgcatcagctcccaagcagtaaggcgtgaaccttgcaggacaggccttgtttcacaggcataaatgtgcaatcccaaatctttttgtttggccaagtaaaacggagctagcgccgttccatagcggcttgtcgcgattgagccggcattgcagattgtcatgatcctgtcgccttttttgaaaagctgcagggcgttttggccgatcaaccggcacgtttcctcatcctcgacctgaatctgaatggcttcatggacaaggtttgtttttgcttcatttacggaaatcgcgttttcgaccgaatgactcagtctctcaagcgcccatgacaaattaatggcggtaggccgtgaactgtttaaatattgtttgatgtcttccagtctgcggcggaattccgtgacattatctgtttcaatgtttttggcagcaagcgccagtccgaaggcagccgtaatgccgatcgccggagcgccccttactttgagcgtgacaatcgcatcaaatacatcctctttcgtcgtcagctccaaatattccgtctcatcaggaagcttttgctgatttaaaatggtaatagctgtttctttccattcaacagaacgtggaacagcaaatgaatgggtcatgaatggatcattcctttacaagtaacttaaataattcaataacatctgttatcgttttgaattccgaacgtttttcgataaaggctgtgccggtttcgagcgccaggcgttttctgccgattcgtttatcaaacggcacgatcgtatccaggtcagctacatgggcaaggccgatcgtgcgtcgtatcagctcacagcccgcaaatccgattgcttcttcaaaaatatggctgagcgtatcagtgaggtaaccgtcgatgttggcgtaaacatccagactgtcattctgccaggcttcactaaacgtctcttcaaacgtttcccagacctggttgacatgttcatataacggctctctgtcagccccgtcacggctgagtgcgttcaaaaataagttggcgataaattgccctacatcaaagccgatcggtccgtaaaaagcaaactcaggatcaatcacctttgtttcgtgctcacttgcgaaaatgcttcctgtatgcaaatcaccatgaatcaacgtttctgcagacgttaaaaatgactttttcagcttagcggcttcgattttaacgctgtcattattccaaagcttttcgacaaaaggacgaagctcttcttcaaaatcatttgtgtcatggtcgaagaaaggatctgtaaaaacaagtctttccgtaatgtcgcatagctctggatttgtaaactgtttaacaagctgttttttcaccttaggttcaagcgcgtaatctgatgagtagaaaagtgtttttcctaaaaattcaccgatgtgctgcgacagatgaggatagttttcaccctcaatgagtccttttcttgcgatcttgaggtgagagagatcctccatgacggtaaccgccatttccgtatcagaataaaaaactcttggaaccaggtgaggcacatgctcgccctgacggatgagagcgctgctttcgattcttgcacggtcgattgtcagcggccagctttctcccaccacttttgcatacggaaccgcctgtttaatgatcaatgctctgtcatgttcttgatcataaatatgaaaaacgtaatttaagttgccgtctccgatctcctggcatgtcagcgtgcttttgcttggaaataggccaagcttcaccgccaacgccacagcggagctttcatttaatgtttcgtataaaggtgtttttgtgactcccatcatcataacctccaattatgtaatcacttaatatgtggccgtaaaaaagcctccttctcagagagaaggaggcttaacatctatgtccgcctctcttatctctcagatcagatctgaatggaattagcaccgtgccttaagagaccagcgtctcggcgcgaaaaagatgcgccccatttcacaatggaattacggtcggttgctgttggggtcaaaaggccaaatccctcgcccaactctcgataagagaatatattcacttgtttgacaattctaatttatcagttgatgaacatggtaacaggtaatttagttagttgtcaatatattttttaatataaatcttttctgatatcatcgaaaacaggaatgctctcccgaacttctgcgctttcttgaaggtcgatttccgctcggactatgccttcttcccggctgccttcagcaagtacacgcccccatggatcaataattaggctatgtcctgcaaattcattatccggatttgaaccggtacaattgcaggctgcgacaaagcattggttttcaatggcccgcgcaataagcaggcttttccaatgatcaaggcggggaagaggccattccgcagaaataaacagcacgttggcgccttttgtcgtatgttttctgatccattccggaaaacggatatcgtaacagatcaatcctgagcttttgacgccgtcaagctcaaagtatccgtcttcggaaccggctgataaatacagatgctcatccatcagctgaaaaagatgggcttttctgtactctttaatgatttgcccttccttatccgcgatgtacattgtattataaacatcagaattcttcctgacagcgaccgatccggcgacaatatgaacaccatgtttttttgccgttttcttcagccagctctgagcggagcggccgtcttcatcagcgagttcatcaagattggccaggtcatatccggtcgtccataattcaggcagaacaagaacatcagcatgtttgctttctttttcgatgaaaaattcagccttttttatattttccgaaggttttccgtatgaaatatcaaattgaagacaagatatcgtccatttcatctttttaacaccccaaatttttctttacttttttcatttaaccatatatgatgatggactatcatttcaagatttttttagaaggtgagaatagatgaaatttgaacagtctcatgtattgaaggaattgcctaaacaattcttcgcttctctggtgcagaaagtgaaccgaaagctcgcagaaggacatgacgttatcaatctaggacagggaaatccagatcagccgactcctgaacatattgtcgaggagatgaaacgagctgttgctgatcctgagaatcataaatattcgtcttttcgcggctcataccgtctgaagtcagcggctgctgcattttacaaaagagagtacggcattgatctggatccggaaaccgaagtcgctgtattattcggcggaaaagccggtcttgtcgagctcccgcaatgcttgttgaatcccggtgatacgatcttagttcccgatccgggttatccagattactggtcgggtgtcacacttgcaaaagcaaagatggaaatgatgccgctcgtaaaggacagggcgtttctccctgattacagcagcataaccgctgaagtaagggaacaggcgaaattgatgtatttgaattatccgaataatccgaccggagctgttgctacttccgagttctttgaagataccgtgcgttttgcggctgaaaacggaatctgcgtcgttcatgattttgcttacggtgctgtaggatttgacggctgcaagcctttaagctttttgcagactgaaggtgcgaaggatatcggcattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggtagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtaaatatggcgagggctacgtcagagtcggacttttaacaagtgaagaaagacttaaggaagccgcttatcgaattggcaaactgaacctgtttacccaaaaaagcattgacaagaccctataacgatgggataattcaaaataatttataaaatctatattttcttatcaagagcaggcagagggacgagcccgatgaagcccggcaaccgacttatgaagcacggtgctaattcttgcagctagcggctgagagataagattcggacgagaaacgaaacctctttagacgcgattgcagtttgaagaggttttttgatatggatgaaaatgaaaggagctctggcatgagtgagttattagcgacatatctcctgaccgaaccgggagccgatacagagaagaaagcagaacaaatcgcaacaggattgacagtaggctcctggactgatctgccccttgtaaaacaggagcaaatgcaaaagcataaggggcgggtgataaaagttgaggagagagagggaactgctgcatcagaaaaacaagcggtcatcacaattgcctatcctgaaatcaatttctctcaggatattccggctttgctgacaacagtgtttggcaagctgtcgctggacggaaaaatcaaattgatcgatcttcacttctctgaagcatttaagcgtgcactgccgggaccgaagtttggcgtatacggcatccggaagctgctgggagagtttgagagaccgctgttaatgagcatatttaaaggcgtaatcggaagggacctgagtgatattaaagaacagctccggcagcaggcgcttggcggagttgacttgattaaagacgatgaaattttctttgagacaggtctagcgccttttgaaacaagaattgcagaaggaaagcaaatattgaaagaaacgtatgagcaaaccggacataaaacgctgtatgcggtgaatttgaccggacgtacggctgatctgaaagacaaagctagacgcgccgccgagctgggagcggatgcgcttttgtttaatgtcttcgcttacggcttggacgttatgcaaggccttgcagaagatcctgaaatcccagttccgattatggcgcatccagcagtcagcggagcgtttacgtcttctccgttttacggtttttctcacgctcttttactcggaaaattaaaccgatattgcggtgctgacttcagcctctttccgtctccatatggttcggttgcgcttccaagagcagacgcactggcgattcatgaagaatgtgtgagagaggatgcttttaaccaaacatttgcggttccgtcagcaggcattcatcccggcatggttccgctattaatgcgtgatttcggcatagaccacattattaacgccggaggaggcgtacatggacatccgaacggtgcccaaggcggagggcgagcgttcagagccattattgatgcggtcctagaggcccagccgattgatgaaaaagccgaacaatgcaaggatcttaagcttgcgctagataaatggggaaaggttgaagccgtatgacgactcgaaaaccttttattatttgtgattttgacggaactatcacgatgaacgacaacattataaatatcatgaaaacatttgctcccccagagtgggtggcattaaaagacggcgtactttccaaaacgctgtcgatcaaggaaggtgtcgggcggatgttcggccttctgcccagccgtttaaaagaagagattacaagttttgtattagaagatgcaaaaatcagggaaggctttcgggaatttgtagcatttatcaatgagcacgagattccgttttatgttataagcggtggaatggacttctttgtatatcctttgcttgaaggcattgtggagaaagaccgcatttattgcaaccatgcttcatttgacaatgactatatccatattgactggcctcattcctgcaagggcacatgcagcaatcaatgcgggtgctgtaagccgtcggtcatccatgaactttctgaaccgaaccaatatatcatcatgatcggtgattcggttacagatgtggaggcagcaaagctgtctgacctatgctttgcaagggattatttattaaacgaatgccgggagcaaaacctcaatcatcttccgtatcaagatttttatgagatcagaaaggaaattgagaatgtaaaggaggtacaggaatggctgcaaaacaagaacgctggcgagagctcgctgaagtaaaaagggaattggcagagagagattggtttccggcgactagcggcaatctgtcaattaaggttacagatgatcctttaacatttctcgtcactgcaagcggaaaagataaacgcaaagagacggttgaagattttctgctggttgatcaaaacggagagcctgctgaaagcgggcattctctgaaaccgtcagcagaaacgcttttgcatacacatttgtacaataaaaccaatgccggatgctgcctgcatgtccatacggtaaacaataatgtgatttcagagttatacggagaccaaaagaaaatcacattcaaaggccaggaaattataaaagcactcggcttgtgggaagagaacgcagaagtgaccattccgattatagaaaatccggcacatatcccgacgcttgcggcactgtttgcggaagagatttcagaagattcaggagctgttctgatccgaaatcatggtattacggcttgggggaaaacagcatttgaggcaaaaagagtgcttgaagcgtatgaatttttgttcagctaccatttgaaattgaaaacactccagcatcagctggttaaataaaaggaggaattgaaatggctacaattcgaattcatgatgaggcaaatacaacgattgaaaatcaagaggaagtggcaagctttctggacagtcaagaggttatttatgagcaatgggatatcacgaagcttccggaacatctctcagagaaatatgacctgacagaagaagaaaaacagcaaattcttgataccttcgaaactgaaattaaagatatctcaacccgccgcggctataaagcccaggatgttatttcattgtcagacagcaatccgaaacttgatgaactgcttgaaaactttaaaagagagcatcaccatacagacgatgaggttcgttttattgtaagcggtcacggtatttttgtcattcaaggcaagggcggcacgttttttgatgtccgtttaaaccctggagatttaatctctgtgcctgagaatatccgccattacttcacgcttcaggaggaccgcaaagttgtcgcggtgagaatttttgtcacaactgaaggctgggttccgatttatgaaaaagacagcgtgaatcaataagcatgagaaagccccgttcatcgaacggggctttttatatttattgcaaacgccacttttcatactgtgacagttcttttttaatcagtgtccaaatcaaacttaaaacagctgcatcgtcaatgaacccaagaccgaggattacgtctggaatgatatcgagcggcatgacgatatacaggattgcggcagttaacagcaaaagtgttttaacctgtgaacgagggtagtcgccatttcgccaatcgcgaagcatctgaaaaaaagtagtgatgtgctgaatacatttttttcggtttttccttttcaaaattgcttttccgcctgccgctccgagcataattgctttctttttcttcattgggcatacctcctgcctggcggcgtgtttaagatattcttcacctgggtattgttcttctaatcctatcaatatatctattatacctgaaaaattaacttatttaatgaaaatatgtttacaaataaagtataatctgtaataatgcacaataacccaatcaaacttgtttcctatttcttagcggcgaggggtgaagtgaatgggcggttcttctgaacaagaaagattgttggtgtctattgatgaaaaaagaaagttaatgatagatgccgctagaaagcagggatttacagggcatgacacgatcaggcacagtcaggagctggattgtttaataaatgaatatcaccagcttatgcacgaaaacgaacattcccaaggaattcaaggccttgtaaagaaattaggcttgtggccccgcagagatgttatgccagcatatgatgcaaataaatagcggcctatcagatgcatatataaagagagagcttttcggaagcgctctttttttctggaaaaaattcatatgaaagagggaactaatgaaagaactggcgattctcattaccgaaatggtcaatcaatttcatgatgcttttatttccttatgcggaatatttggcattcatttaactgacaaagaaatgcatttttgggtgatcggcatttttggcatattctttttcggcgtcactcacgctgtgtttacatggctttctaaatggagtatgacagccttgtcctttatctataccgttacagtcatcattgtcatcgtatttgcgattgagattcagcaaaaggtgacggggagagggaatatggagtttttagatgccacggaaggtataaagggttttttagtattttttatgttttttttgcttttgaaaatgctgttgcgtttcatcaaagtccttttttctggaagaccagcaagcaaatcgaatggcaatgcccgatcacgaagataaaaaaccctcctgacatggtcagggggctatgaagcggatacggggagggtgattgtcacctctgtgcctcttcgcacttcactttcaatatgaatagagcctccgtacatcagcacgatccgtttacaaacaacaaggccgagcccggttcctttttctttagaagtaacaaagggaaggaagatgtgatccagcatttcctgagaaatcccttcaccgttatccacaactttgattatggcttttttatctaaagctcccagggaaatcgttagtttgcctccttcaggcattgactcgaggccattttttgctacatttaaaatcacttgtttaatatgatcttttgtacattttacgagtaagggctgctcggttaaatactgtaattcgacttcaacattgtatagattgccctcagaataaatgatcggcataatctctccgataatgtcctgaagtgagttcagctcccatttttcagctgtcggcttgccgagaacgagaaactcactcactatttgattgatgcgctttatctcctgttcgataatggagaagtaaagctgatcttcctcacctttatatttcttttgcaacagctgaataaagccgcttatcccggtgagggggttacggatttcatgggctgtgctggcagcaagcgtcccgatcagctctaatttttgcgcctcgttttctgagcgctccagctgggtctgccgcttcagcaaataatacagcacgagaataaaaaggatattcagcagaacaataatacatgaaagcggaagcactaggcttttcgtcagttcttctattgtgaccgggttcggatagactttcatattccagctgatatcatccagatatccgctgacaggtttctgatcctctgcatgagaggcttgtccgctcgcaaaaatcattttcccgtcttggtttacaacttcaatataaacatcagggcttagtaagttaatgagatttttcaaataatcaatttgaatagctgcgacaagataatctgtcacattacgttttgagtccaaaacagggacacaaattgtgaaaattggctgaccagtaattctgctcgaataactatctgaaatgactgtctttttagtttcctttgcttttgtaaaaaaagatctgtcggccaggtttactttcgtttttaattcggttgtgcttgcggtgacgtctcctttggcattgagaaaatagagaccggaaaatctcggctctgaatcaaaggtcttttccaaaattgactgcattttctttatatcaaccggtctgtcgatggcgatggacaaggaggtcattctcgccattgtttctccgattaaataattgattttgttgcggtgaaggtttagcaggacacttgcttcttgtttatgttctgcagctattgtatctttttctttttcatatacgaaaaagctgatgacgattgccggaatcacgaccagtatgatataaagtttgactctcccgcaggcgccttttagtattttcaatttgcatcgctccaacatacacctgattagaggtattatatcattgtttcttcttctttaataagaaaaaataaccaaaaaattagaaaaagatgttggcaagcttacattttaaaaaagaagagaaatattggaaagatttttattgacattttggtctttgtttattaatgtttctctgtaacggtttctaaaaggatgattgagacatgacagaaaaatcactgaagttatttatcgtgctgtcgcgcgcgtatcggtctattaacgatcatatgaataagcatattcataagcatgggctgaatccgactgaatttgctgtgctagagcttttgtaccataaaggcgatcagccgctgcagcagataggagataaaattctcttggctagcgggagcatcacatacgttgtagataagctggagcaaaaagaacttctcattcggaaagcgtctcctacagacagacgagtgacatttgcgcaaattactgaaaaaggcatcggtcttttgaacgatattttccctgatcacgctgctgaaattgatgaaatgatcagcgtattaagcgaagaagaggtagagatgtgcaccgaaatgttaaaaagagtaggattaaacgcaaaacagtttcataataagtaaaaaaaggaagcctgatatgtcacaaggcttccttttttgctatttttcatttgtttccgctgcgcctctcggcaaaatgagaacttcaacccgccggtttttgcttcggccttccgcagttttattggaagccaccggtttatactcgccataacccttggcgctgaacacttttgcatcgagcttggggttttcaatcaggagccccataaagtttaccgctctcatgacgcttaaatgccagtttgattggaattcagaatttttaattggcatattatcagtatgtccgctgataatgatatttcttggcgggttaatcacaagaagatttgaaatctcttttgcaagcggcacatcttccttacggatggtcgcttttccagaatcaaagaagatgctgtctttaatcgtaatcagaaggccttcactagtcatcttcgtctccagctgatgttccagctttttatctttgatgaacttttccacctggctcttcacattttcaagttcttcttgatcagctgctttttctttttctttcttgtttttctctttctcttctttttcctttttcacttcatcgatgccgtctgactcgttttcaggaggagtgacactggagtagtccagtacaccggtgccgcctgtaaaaacttcattaaatgattttgagagcatttgaaacttagctgcgtcaatcgagctgctcgcgtacagcacaataaacaatgccaggagaagagtaaggatgtcggcgtaaggaacgagccatgattcatcaacgtgctcgtcctcatgcttcttcttcttttttctcgccattttgcgcctctccttgttctgcaaatttcaagcggtccttcgcaggaagatacattaaaagcttttgttcgatgactttcggtgcttgtccttctaaaacggataaaacaccctcaatcatgacctcacgcagttttacttcttgttttgattttcgttttaatttatttgcgaaaggatgccataacacataccctgtaaagataccgagaagtgtggcaacaaaggcggcactgatggcgtgtccaagctcatctgtattgtccatatgagagagagcggcaatcagcccgattacagcgccgagtactccaagtgtcggggcgtacgttcccgcttgtgtaaaaatagcggctccggcttggtgcctgtcctccattgcttcgacttcctctgtcataatatctctgataaattccgcgctttgcccgtcaacagccatgctgagcccgtttttcaagaaagcatcatctacatcctcaatgcttgcttctaaagcaagcagaccttcgcggcgtgcaagctgagcccattcagagaacataggaatgagttcctctattgtgagctgtttattttccttaaataacactcgaaacagcgcaggcacttttttaatttcttttgttgggaacgcaataacgactgctgagattgtcccggcgataataattaaaatggcagcggggtttgcaagggcgctgaaactgacgcctttcagaaccatcccgacgctcaatgctacaaaagcaagaataataccgattaacgaagttttatccatagttttcaccaaatccttttttactagcttgtctatggttaatatcggttttggtgcccggaactttagggacattgtgaatttgttcatgaaatattcaaggaagaggcatagaagggagaaataaacaaaaacgggctctccaaaattgaaaagcccgggggtctactgaaattggcagctttcttgcaagctgtccttcagatggtattcgtataatagtagaaatacatattcactgtatataaacatgttccatccctccttaaaaaaagtgtaaaggatgaagggaagtagcgcttcagggaaagggaccgtattttctaagtcaagagtatgaaagcataaaaaaagcggcttcctttaaggaaaccgctgattgttatttcgctcgcactttgattttatcatcttctaaaatcacgtgaaaacttgtgatctcgccattatcaagcagcagatcggtcatttcatcctcaacccattcttggatggttcttctaagcggacgtgcaccgaatgaagggtggtagcccagctcagcgattttttctttcgcttcatctgtcacattcaagctaatgccccgttcagccaatgtttcttcaagttctccaagaagaaggctgacgattttgacaagatgttctttttccaatgagcggaactcaataatgctgtcaaaacggttgaggaactcaggtttaaagaacatgctcagtgaatcaattaatgtttgttcttcgatgacactgtcatctgattggaaaccgactttcgtttgtttctcaccagcacccgcattacttgtcatgatgatcactgtgtctttgaagcttacggttctgccttggctgtctgtcagacggccatcctccataatttgcaggaacatatgctgaacgtctgggtgtgctttttcaatctcatccagcaacacaatgctgtaaggattgcggcgcactttctcagttaattgtccagcttcctcatggccgacatatccaggcggtgaaccgataattttagatacggcgtgtttctccatgtattcgctcatatcgagtcggataatagcgtcttttgtgccgaataattcatctgccagtgttttagaaagctctgttttccctacgccggtaggacctacgaagaggaaggagccgactggtctgtttttggattttaatccggcgcggcttcgtcttaccgcttttgccactttttgaacagcggcttcttgtccgatcacgcgttcatgaagttttgcttcaagctctttcattttcgtttgttcgtctgcctgcagtttgccgacagggatgcctgttttttgttcaataatttcctgaatgtgctcagcttccacagtgacagcggtatgagcggaggagctgttcagttttttctccaatgcgagttcttcatcacggagttttgccgccagttcgtaattttcttcttccagggcttttgttttttcggcttcaattgcagttaagcgttcagcggcatcctcatcattcagttcatcaattaacaggttggcttttgaacctgcttcatctaataaatcaattgctttatccggcaggtgtctgtcctgaatgtagcgggatgataaagtgacacacgctttgattgcttcatcactgaatgttacgctatggtatgcctcgtatttgtctttaatcccttgcagaatgaggatagcctgttcaattgaaggctcctgcaccatgacaggctgaaaacgtctttccagcgcggcatctttttcgatttgacgatattctttcagtgttgtcgcgccaatgacttgcagttcgcctctggctagggccggtttgagaatgttgccggcgtccattgatccttctgcagagcctgcgccgacgagaaggtgaatttcatcaatgaacagaatgacattttttcgttccttcagctcagtgatcagctgtttcattctctcctcaaattggcctctgatccctgtgtttgcaacaagggatgcaacatcaagcaaatatagctctttgtttttcagtttgtttggaacatcaccttcagcaatttttaaagcgagcccttcagcgatggcagttttccctacacccggctcaccaataagaaccggattgtttttgttccggcggtttagaatttcgatcactcgcgccacttcatcatcacggccgatgacggggtcaatgagaccggcttttgcaccgtttgtaatattttgagccagctcatcaagcaacccttttttttcgctttgttttgctgcgctctgttctttcggctggaatgcctgttcaaacggaaatccgaaagattgaggacccatactcattgaaggtttacgggtcagttcgttatagcaagtttcacaaagaaccatctgtttatgaacggaatttatttgcatgttaaggcgaatcgtcgcctcgttttgatgacaatgttgacaacgcatttgccaaaacctccttaataatttgatcatctttgaccaatgaaagtgaataaaaaggtctattggatttgaccttctttgactattagtatacggcaaacttaacggcattcaaaccaatatgctcaaagcagactgaatatttgactatctttgaccaattgatttttaaaaaaggccggtttgtttgaccaactttgattaatagtatactctgactatctttgactttcaagtcttatgcacaaaaatttttgatttgttacaaagtaaaacatgttttcttcgtcttttcaaggaacttgtctcataggttataaaaaggcatatatggacaaaactgcggttcgttcggagggaagaaatggaacaatcaaaagggtctgcaagtcagcttgcttttgtgtatgtcggcacagtagtcggagctggatttgcgactgggagggaaattgttgagttttttctgaagttcggctggttcggtttattcggcattctcgtcagcggcggaatgtttacgttactgggggccaagctgatgatcatttcaaagcgaatcaatgccaagtcatatcaagaaatgaacatatttttgttcggggcgacggctgggcggattatcaatgtatttatgctgtttgttctccttggagttacatctgttatgctttcaggggcaggggcgctttttgaggaacagctggggatgtccgctcagattgggatgctcattacaatcggtctgagcttaattgtgatgactagaggagtaaagggcattttcggtgtcaatgtgtttgttgttcctcttttaatcatcttttcaatgattgtggtggccgactcttttatattcagcgaatcacgtaacgcagctcagtgggtctggccacatcgctgggattggctgttatcagcagtttcttacggggctttaaatttatcgcttgcccaagctgttttggttccgctggcgaatgaaatgtcatcggagaaagtgataaaaaaaggcgctttaatcggaggcacgatgctgacgattgtgctgtccgcgagttttctgtctttgtcgactcttccggatgtatttttgtatgatataccgatggcgcaagtggtttatctctttgcacgatctgtccatttgatttacttactcattattttcggagaagtgtttacatcagttatcggtaatctatatggattagaaaaacaagtgcaaagctttcttccagtgaaaagcaaatatatctttgcagccattatgatcacggcttatattacgagccaaatagggtacggcaggcttatttcaacgatttatcccttgtttggctatgtgagcctggccttcataggcgctttgctttgcaaaaaagctcctcggcggcgcagtttataaatatatataatgaaacgaaccgtcactatagagcgataattgatctaggaaccggggactgacttttttattgtcaagaaaaacaacattatggtaagatagcagaagtgaaaaaattgaagaaaatccgtgcgatatgcgggagaggttctagctacaccctctataaaaaactaaggacgagctgtatccttggatacggccttttttatgtttttctagagcaccttccgaaaaaaggtgtttttttgcgtgaattagctgtagcgatatctctcgccgacgtttttattgcggagaaggagaggaatcatgaaaaaagaaaaagcaattgtcgtatttagcggcggtcaagacagcacaacatgcttactgtgggccttaaaagaattcgaagaagtcgaaacggtgacttttcattataatcagcgacattcgcaggaaattgaagtggcaaaatccattgcggaaaagcttggtgtgaaaaatcatttgcttgatatgtcacttttaaatcagcttgcaccgaatgccctgactagaaatgatattgagatagaagtaaaagacggagaactgccatccacattcgttccaggccgcaatttggttttcttatcctttgcgtctatcctggcttaccaaattggcgcgcgccacattattacaggagtttgcgagacagacttcagcggttatcctgactgccgtgacgaattcgtgaaatcttgcaatgtcacggtaaatctggcaatggagaagccgtttgtgatccacacgcctctcatgtggctcaataaggcggaaacgtggaagcttgcagatgagcttggcgcgctggattttgtgaaaaacaacacgctgacatgctataacggcatcatcgcagacggctgcggcgaatgtccggcatgtcaccttcgttcaaaaggttatgaagaatatatgatgatgaaaggagagcgtgcataaattgttatctcaaatttatccgcaggcccagcatccatattcgtttgaactgaataaggacatgcatatctcagccgctcattttatccctcgggaaagtgcgggagcgtgcagcagggttcacgggcatacgtataccgtaaatataaccgttgccggcgacgaacttgacgattcaggctttcttgtcaatttcagcgtactcaaaaaactggtgcacggaaactatgatcatacgctattaaatgatcatgaagatttttctcaggatgaccggtattcgctgccgacaactgaagtcgtggcgaaaacgatttatgacaaggtgcaggcttatttagacactttggagaataagccgacctgtgtacaggtgtttgtccgtgaaacaccgacaagctactgtgtctaccgtccgaaaaagggtggtttgaatggctaaaggaattcctgtattagaaattttcggcccgacgattcaaggagaaggcatggtgattggacagaaaacgatgttcgtccggacagccggctgcgattattcctgcagctggtgtgactccgccttcacttgggacgggtctgctaaaaaagatattcgctggatgacggcggaggagatttttgcggagcttaaggacattgggggagacgcgttttctcatgtaacgatctcaggcggcaacccggccctgttaaaacagctggatgcttttattgaactgctgaaggaaaataacatccgtgcagcgcttgaaactcaagggaccgtttatcaggattggtttacgctgattgatgacctgacaatttctccaaaaccgccaagctcaaaaatggtaacgaactttcaaaagcttgaccacattttaacttcacttcaagagaatgatagacagcatgctgtcagcttgaaggttgtcatctttaatgatgaagatctggaatttgctaaaactgtgcacaagcggtatccgggaatcccgttttatttacaagtcggaaatgatgacgtgcatacgacagatgatcagtcactgattgcacatttgcttggaaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattgctaggcaatcaaggtacaaattatttgttcgaatatgcaccggacgtgctggaatccttcccgaataaacatgtaaaccgtgattactttgtaaaattcaattgcccggaattcacatctttatgtcctaaaacaggccagcctgactttgcgacaatctacatcagctacattcctgatgaaaaaatggttgaaagcaaatcattaaagctgtatctattcagcttcagaaaccatggtgacttccacgaggactgcatgaatatcatcatgaatgacttgattgaattaatggacccgcgctacatcgaagtatggggcaaattcacgccaagaggcggaatttccatcgatccgtacacaaactacggaaaacctggcacgaaatatgagaaaatggccgagtaccgcatgatgaatcatgatttgtatccggagacgattgataatcgttaattattccgttgtgtgatacggagtgtgaaacgaagtggagtcacagtaaaatccgaacattcagtgctaattttcagcggaattgtgaccgagtcacagcgaattgtgaccggagtgtgacccgcactaagctcaataaaagtgggaaaagtcaaacctgaaaatggctctactcatggaaattgtattaaaaagtgtcacctgaggtgcaacctgaactgtgacttttatgcagtgaaaaattgatagtacagaagcagattaaggcgtacaatttgtacgtcttttcttttttatccgaatgaaaaaatgcctatctagagatcataggcattaaatattattatcaatatcttcatttattttttggctaagtttctgaaccttctctttaacatttgaaacagctcttttttgaatttcatcaaagttctcctgaatatagtcgatgacacttcttattagaacttcactttcaaaattgaatatctcatttatttctgactgttcttcatctgttaggtgatggtattgaagttgtttagcatttacttcagcagctacatcaatactaacttagttgttctggttgtacaatttcatattcaccttctgtatactcttgctctgcataatggcttccccattgacagagctcctgcaagataggtttaagagattctccaagttcagtggatgaatattcaaccttcggcggtacttgattatacatctttctgctcacaagtccactggcttcaagctctctaagtgtttgaatcagcattttctgagttatatttgggataatgcgctttaattcactcgttctctttggtccattcattaaaaagtataatacaaggcctttccattttccgccaataacttcctttgtcacttcaaacccacaactaaattttttcattgtctaaagctctccattccacatttattactttttagttactatatcacaaaaaagtgggtacttccgataatgtgcttactgaaggatactatatcttgtaagttgttcttcaagtacttaaaggtactagacataaaataaaattaattctaaaggagtgttaagtatgggtaaatttgaaggtaaaatagcacttgtaacgggtggaacaagtgggattggtcttgctacagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcgttatcactattcccgaacaaagtaggttctattattgtaacgggctctactgctggatcaattggcaacccagcgtttagtgtatatggagcatctaaagcagcattaagagcactggttcgcaactggattcttgacctaaaaggtactgaaatccgtgtaaatgtggttagtccaggaggtattcttacacctgcctacgatgagctttttggtgatgcacttgaagaagtaatggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataatttcactgcacagagattacaaatagtccccaaaaaaggttaatggggatttacttgaagaagtcgcataaaaaagtcgttttccttaaaggacagggaattcgacttttttatgtttgaatttgattaacgttgtaaattcgcattttcctggggctaccactaaatgacctgtaaaaaagattactttgtgaataaatgtacttaaagtaacgggggctcttgacttttaataaaaaataatatccctgtccttgtattctaatacttttgaaaatatttaaaggaatccttatgtcctgaataaccacataggaaaatatgttgtaggttgctttctttttttgggggcatcccacacaagctatcacgtgatctcacacctgaacgtttttttatagactagtaccgcgacaagttatattacatatacataccaataaagtagacattaaaaagtgaaagagaggatggaaatgtgtgaaaattcttttccttgagagtcatcccatgtggctctatggtttaccgaatgggtttagggaagcaggacataccgtaatgatttccggtcctgtaagtcgggaaaatatcactgaaatgatagacgaatttaaaccagatctaatagtatctatgggatggacaccagagcattcaagggaaaagcaggcctggattcgcagcgctactaaaaaggtgaatatccctctcgtttattgggcaactgaagacccgctgcacactcaaaactttactatcccgttaattaaaaagatgaaaccggattttgttttcacggttacgccttctctgtgtaaaacttatgaaagcatggggattaaagcagctcacttagactttgcatttcacgaaagtatacatcaccagattaaaccattagcaaaatacagttgtgatatagcggtggtggctaatgcttaccctaattttcttgaagaacatccggatgtgttccgttcgtcctctttaaaaacgcttattcgtcctcttatacggaaaggtattcgtattgatttttggggagaaactgggaaaaaatgagtaaatatataggaagagaaattccccgcaattggatccatggataccttgattatactgaagcatataaagtttacagttcagcaaaaatcattatcggtttgcaaaactgtgaaagccaacttacgcaacgcacctatgagattcttggttccgggggtttttattgacatcggctacaccagcagttcgaggtaaattcaaacctggccgcgatctcatcgtttcttcctccccaaaagaaacattggaaaaggttaaatactatttgaatcatgatagcgagagaaaaaagattcagataaacggtaaaaaggctgtaaagaatgattcctatcggcatagagccgagagaatgcttgaggtgctaaaaagcagaggaattataagaaacttaggggaaaccattcattatgtagatgttctcaaagaaaaatacgtgatccatcatgttactcccggtgaaacattatcaataatttccaggaagtataacgtttccctgcagcaactcatggagcttaatcatttcaaatcagatcaaatatatgctggacaaatcattaagattagagagaaactgtttagaaatattaataacaaatttttctaaaggagagtaatatgaatgaaggggaaaataccaaaaataagaaatcaagcgaataaagtaaaaagaacgcctcgttatatggaatttccagtgacatacgaagtatatcatgtggaatccggcgatacattatggacgattgccaaatcctttaaaattccagtacaacaacttatgaatcttaataagctttcttcagatagaatttatcctggacaaattataaagataagagaaagataatctttgaggtttcggaaacgaatcaaattgaaatgacaatcctcatttttttatttgtggggaacttgatatttttggggatgaaggggttatgagatgtttcaaatgagctatttctattctggattaggatgggattttattcaacacgttgatcaaacgaacggagtattaaatgttgtgtctcctgattttttctatatcagaaaagatggatcattacttctccgttcagctaatcccgatgtgattaaagctcttcatagaagaaaattaaaagtagttccttttctaagcaatcattgggatcaggatttgggacgatttgcattaatgaaccgagttcttttagctaaacaaatttctcatgcaatagaagaactggatttggacggagttaatatcgatatagaaaaccttacagaaaaagatcggaatctatttacagattttattagattagtaaggaaaagtattcctagacataaagaagtatcagttgcagtggcggcaaatccttttggctggacgaagggctggcacggatcatatgattacgagtatttagctaaatatgcagattatcttatggttatggcctatgatgaaagccgtcttgctgggcctaccgcaagtgtaggatgggtggaaaagtccattcaatatgttctgacccaaaaaatctctcctcaaaaactagttttaggattgccattctatggccgctgctggatggaaggccaatctgcctctcaagccattcccctttaccttgttgactccttagtaaaaaggcatagcgggacaattatttttgacaccaagagtcaatctccaaaagctatttttactgtcaatcacaataacaaggggccgttgccttcgggaacatatacattatggtttgaaaatgaacagtcactcagagcaaaaataaaactcgctcaaaaatataatctgaaaggtcttggcagctggagtcttggacaagaagatgtgtcagtctggaatacagtgtttaaaaatatataatgatttatagttcagaaaaaaattcgaagataattgcaatgaatctctaaatggacatactgaaaggagtttattacgggtgcgggtaaaacagtgagggcattccataggcccttctcccgaaatgttctatacgaggcattacattgggcttgaaatacacattcaaacttatgttatagtacgcatttcaagtaattacggatgtgttgaatttattctgcttccatgattcaagtcatacacatgctaccttgatagcaggattattgcgtttcattcagaattgttcaggatcgatatggaagcgcacgaataactagaactttaaaagcatacactcatatacttcctgaatggatgctggtttatctaaaaaacatgatgagaattgattgaccgctctcattaaaggatggggaaatccaaggcgccaaggtacgcatggtgaaacatgacttgttgataatcgaccatatagtttctccttagaaatgaggcggtttttacataaaaaagacgagcgaatccggggggaattccactcgccgctttctaatgaaaagacgggatgctggatggcagctcgtctgttttattataatttaacgaacgtatgtttgtaaagatgtcttttcgaatgaattggttcatataaccgttaagaacagattcattgtaaacattcgctaaggtatgctaagatgcatggactataaaggagtgatatgaagtgaagacattgcggttaaacaatgtaacgttagaaatggctgcatatcaagaggagagcgagccgaagcgaaaaattgcatttaccttaaacgttacgagtgagacttaccatgatatcgctgtcctgttgtatgaaaaaacgtttaatgtcgaggttccggaacgcgatcttgccttccgggggaaatgacaaattattcaacatcattgaccaacctgtacgaaccaggggccgtcagcgagttctatatagaaataacggaaatagacaaaaacgccgattcatgatcggtgttttttatgtaaaaaagctgccggccggcagcttttgagaaagcgaatttcatatgtaaggtgttaaattgtccgtcttgcagttttttgaataaatgtggaaataaggaggttttaataggagtctctgatgatcttataatttttatgattaacaactgtcaatgaatctaactcaagatcccgatagttatccatgatcgtcacatcaacgataacagaattctcatttactttttcaacaacaccggttaatccgtttttaaattcaatgacattcccaaccttagcgattttcacaagcttcctctcctttaaacataataatgccttttgaaagtattttgcagtattttcattgagaagtaaagcgataaggagttttatctcccttatgaattgttctgtcgctataaagatgatatattgattttcgtcaatagaaagaaaaggggggaatttttgttgcgacccgaagaaataacagaaatgattgaacagctgcgcaccggcgccataaacgaactgagagtccagaaagagcattttcttgatttcagggccgtgttatctaaacaagatgattttaaacatttccgaggaattgcccagcaaggcggagatgttatttttcaatacttagaacagccaagaagctgaaggtttctcatacgtgagaagcctttttatcatatatgacagaatacaagccttttattacagctgtctgtaacaggtgtaaataaaatgtaaagtgtcaaagatggataaacatgttttaattttacaatatttatagaatttcagactgtttttttgccattaagcagtgagtcatcctctttattccatcctgatacctccttgggagagttggaaaatctttttccgtgaaaatgaatggatctcttgttaaggttatgaagtgttttttggagcactttaaggaggaaactgtatgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaagacaagaaaataaaaccgattaagctatcagcacacactgaaaagaaagagaaagataaaccgaacaaaacaaatgatgagaaagaaacatatacacagtctgaaaaagagttgctgtcccgtctcgttcacgcagaggccaaaggagaatcatataaaggcaaggtcgctgtagcaagcgttgtactgaacaggacggagaaaaaaggttttcctgatacgataagaggagttatttatcagaaaaacgcctttgaaccggtcgcaaacgggagcattaaccaaaagcctgataaagaatcgattgaagctgccgaagaagcgctgtcctcaaaaaatagagaaacagatgccatattcttttataatccgaaaacagcgtcagataattggattcgttcaagaaaaatcgtagaaaaaatcggcagacacgtttttgccgtctaagcatagaagagacaatttgtctcagctgtgctttttttcatataaagagtaaaaataaaataatttttgaacttgtctcatatgatgttggtagtacaagagacaaggagagacatcatgaatcgatttgtgaaagggatcattcttttatccattgccgcctttttcgctgaatgccttgaatttgtcgtcaatatgattttggcgcgggagcttggcgagcatgggatggggctttacatgagtattttgcccacgatctttttaattattgtcatcgcgagcctggaactgccgatatccatttctaaattcattgccgagtcaaatcctaagcttcatgaaagcatgctgaggcacgctttcagaatgacagccatttttactgctttttctactgctgccgctagtattgcgcttccgtttattccggtatttgatacataccacccgtttattaaagggattgtcatcggcttaattcctgttgtcgcctttacttcaatcgccaggggctactttatgggtgtgcagaaaatggggaagatcgcaattgccaatgtgctgaaaaaaatcatccagctcttgtgcttattcctcttttttcaatggtactcatttgaattggacatggccgtgctgatttccttgtttgttctggtcgtgagtgatgtggtcgtgcttgtttatttatattcacaatttatcatggcaaggcgggcgttatccggccagcagcacattcatttgcgcggaaaggatgtaaggaaaagactgcttgctgtttcaattcctacaacaggactgcgtatttttcatgcggttgtcaatgcaattgaaccctttttagtaaaaggagctcttttggctgcgggtgttgccgggacagcggcgatcgatcaatacggaatgctggcaggagtggctgtgacgatagggtcgttccctgcttttattgcccattcgttaatggtcgtcatgataccgagtatttcggaagcttatgcactttctcagtatgacatcgtgttaaaaaggctgaagcagtcgattttcattacattaggttacggtatacctgccgtctgggtcatgttccagtttgcgggacctctcacgcatttgttttttcactctcctgaagcgcagtattatttgcagctgttgtggccttactttctctttcatctgtttgtcatgccgctgcaggcgtgcttaatcgggatgggttttgtgaaagaggctttttatcacaatgtatggagccatatcgttgcgctaagtatgatgtatgtactgggatcaatggagaatctgcaaatgctcgggattatccttggaatgaacactggcatgattcttttgacgagcctgcactatgccacgatctgcaaagcattgaaggtatccgtattccttacgggagggaccagaacgccgcgaattgaaggatgatataggaactgcaggggcaagctaattgaaaagcatgaaaggaagattccatgttgacgaagcgcttgcttactatatacattatgttattagggttgattgcatggtttccaggtgcggcacaagctgaggaaaaacagcctgctgttcccgctgtttttcttatgaaaacgatagaaggggaggacatttcgattccgaataaagggcaaaaaacaattctccatttttggacgtcatggtgtccgccctgcaaaaaggagcttccccagtttcaatcgttttatgatgcccatccatctgacagtgtaaagctggtaacggtgaatttagtgaattcggaacaaaatcagcaagtcgttgaagactttattaaagcaaacaagctgacgttcccgattgtccttgactcaaaaggggaattgatgaaggagtatcatatcattacgatcccaacatcatttttgctgaatgaaaagggagaaattgaaaaaacaaaaattggcccgatgacggcggaacaactgaaggaatggacggaagaatagctgagagcatagactctcagcttttttcatatagagaagaagtgaataaacattaatgataattattatcaaaaagaaattaaaataattataattgaaattctcttcgtgcgtgctataataaaggaagacatcaagaaataactgacgataaagctgccttttgggcagcgattttgtttttataagagaaatgaagatgatttacgttctcaattagagaggagaattcgatatgaatgaacaagttatcgttcaacgcgacccgcatgagccattgaaaacagacaagagggaaaaaaactgggcacagcacgcggagcttattgcagcacttgtatcaggcgctcttattttggcaggctggctcttatccggatatcaggtattatccataatacttttcttgctggcttttgtgatcggcggatttgctaaagcaaaggaaggaatcgaagaaacactcgaatccaaaacgctgaatgtagaacttttaatgattttcgctgccgttggttccgccttgatcggatactgggcagagggtgctattttaatatttattttttccttaagcggagctttagaaacatacacgatgaataaaagcagcagagatttaacgtctttaatgcagcttgagcctgaagaagcgacattgatggtcaatggtgaaaccaaaagagttccggtttcagacttgcaggccggtgatatgatcgtgatcaaacctggagaacgcgtagcggcagacggtatcattgaatcgggctcgacaagtcttgacgagtcggctttaacaggtgaatcaatgcctgtagaaaaaaacacaggcgacactgtattcacaggaacggtgaatcgcaatggctccttgactgtccgtgtcacgaaagcaaatgaagattcgttattcagaaaaattatcaaactggttgaatcagcgcaaaatagtgtttcacccgctcaggctttcatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccggcggcgctgtccctgatttcaaatggcgcccgcaacggtatgcttgtgaaaggaagcgtctttcttgaacagctgggctcagtgcaaatgatcgcctttgataaaaccggaactgtaacaaaaggccagcctgccgtagagacgatcagaatagcagaaggattcagtgaagcggaagttcttgaggctgtctatgccatcgaaacgcaatcaagccatccgctcgcccaagccataacggcgtacgctgaaagccgcggcgtgaatcagtccggctacatatctatagaagaaacctcagggtttggcgttatggcagaagtgtcgggtgcgaaatggaaggtcggtaaagcaggttttatcggcgaggaaatggcagcacaatttatgaaacaaacagcatcagatgtcattcaaagcggtcatacaattgtatttgtgaaaaaggatgatcaaatagcaggctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtggcagaatgcctgcctgaccaaaaagtgaatgaaatcaaacggttaaaagaagaattcggaacgattgcaatggtgggtgacggaatcaatgatgcgccggcactcaaagcggcggatgtcggcattgcgatgggcggcggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggcgatggaattgccatttggcgtgattggtcatgagggcagcacgattttagtcatactaaacggtttaagactcctaaaataaaaccagcagcctaatcaggctgctggctttttatgtatcaagctttcccttcatttttgtctttatcagatcttttcataactaggatgagagcgaggatgcagcaaaggaaacccgctgcacagcctatgatagagctgtaataataaaagcccaccatcttcatcccgataaaaggagcggaaattcccaaaaccgttaagagcataactgcttttcgtctgaaaaaattcatcagcaaacggaacaaccccctgcgattgaacgttactgtcagtatacaggaagaggagcaggaaataaaatgcattagaaaatgaaggcgtcgtgaaaggcaaacaccggtaaaacctgttacaatggaagacagaacaatgcattgcaaatggcagggaggaacaagaagtgaatagaatacaacgcgtctcttcatggctgaaggaagcggggcatactgccgcatttattcatacgaaagaaaatgttttttacttaaccggtttttacacagagccgcatgaaagattaatggggttatttatttttcaagaagaggagcctttctttgtttgtccaggaatggaagcaggacaggcccgcaacgcaggctggaatcatgaaatcattggctatgcggatcacgaaaatccgtgggagctgatagagaaggctttgaaaaagcgaaatatcagcatacatatgcttgcggtagaaaaggattcaatctcgctgtcacgtgcagaacagctgaagcatgcgacgggcggggctcaatttgtttcagcagaagaaacactcaatcaatttcgactgattaaagatgacaatgagattcgtttgctgaaagaggcggcaaagcttgcagattacggtgttgaagtcggcacagccgctttgcgtgaaggcatcagtgaagtggaagtgctcgctcaaattgagtatgagctgaagaaaaaaggaattcagggcatgtctttctctacaatggttttattcggagaaaaatctggccagcctcatggaaatcctggtacagccacgttgaaaaaaggtgattttgttttatttgatctcggtgttattcttgatggctattgctctgatattacaagaacgtttgcatacaaaaccatcaatccgaagcaggaggccatttacgagactgtgcttcaagcggaaaaagccgcgattgaggcaagcaaacccggtgtgagaatcggagatctggatttaactgcccgcggaatcattgaaaaagcgggatacggtgattattttcctcaccggcttgggcatggactcggaatttctgtccatgagtatccatcaatgagccaggccaacgatacactgctgcaggaaggcatggtctacacgatcgaaccggggatttatgtgcctgagatcggcggcgtgcgcattgaggatgacgttcacgtaacaaaggacggagcagttgctctgacccaatatccaaaggaattaatcatactgccgtaatagaaataaaaaaggactttgttctcgacatcgtccttttttatctgcattaaataaaaaaatcatcaaatgttcgaaagggtttaatttcatgtttttggttgagaggttttacagcaagacagctgccaccgagaacagtgagacataacccaattaaaatgaagaaacccatgtgatcttctcctttcagcttaaaacacaaaaagatatctggtacgtccatatcatattgtatgaaacgcattccagatcaaggggatttagaaagaagggaatctatggctaatattaaagacattgcagaaaaagccggtgtctctgttacaacggtttcccgagtcataaacaatcatccatacgtcagtgaagacaaacgaaaaagagtgtttgaggcaatggaatcattggagtacacgagaaatattcacgctgtacatttgtcgagaggattttcaaacatgattggtgttgtcttgccgacggttaatctgccatattttgcagagctgattgcaggaatagccgacgcagccgcggaatccggggttcacctctctttattccaaacaaactatgaggtacaaaaagaaatctttgcgctgtcccaattaaagcagcgccaggttgacggcctgattttttgctcaaaggcgcttgctgatgagaaactcatggaatgggagggcccgattttgctttgccagaattcagataatgcccgcttcccaaccatcagcattcctcatcgagaagcatttcggaacggcttggactatttaattgccaaagggcacaaaaaaatagccatctgtttggcaagaaaaaaaggcatgaacagtcattttcgaatcaaagcctacaaagaggcattggaagagatcggcgaggcatttcgtgaagactgggtaattgagaaagcgattacaatcaatgatgggaaggcgctttttcataaatggaatacgtggaaggaaaagccgacggctatttttgttgccaatgaccaagtctcagcagggctttttcttgaagcaaagaaccagcgggtgtcagtaccggatgagcttgcaatcttaagcgttgataaccacgaaatcagccaagcgcttgggatcacaacgatcgatattcagacaagggaaatgggaaagcaggcatttgccatactggaaaaaagaattcaaggacagccgattgaaaggaaagttctggattaccgtctcgtcgaaagatcgactgtttagtgaatgcattgaaaaaaggtttgacgtgcattctgttcgttatgtacgatatgaggtattgaatgacaaaggagctgaggatcgtgaatgggtccttcacagtgaaaaaggtactgaataataacgtattaattgcttctcatcataaatacagcgaagtcgttttaatcggaaaaggtattggtttcggaaaaaaacaagatgatgtcattgaagataaaggctacgataaaatgttcattttaaaagacgagaaggaacaaaagcagtttaaaaagctccttgactatgttgatgaaaagctcgttgatatttcaaacgatgtcatctatcacataagcaataggactaatcactcattaaatgaacatattcacattgcgttgacagaccatatcgcatttgcgatcaaaaggcagcagcagggatttgatatgaaaaatccatttctaatggagactcagtcactatatcctgaggagtaccaaattgccaaagaagtcatagatatgatcaatgaaaaagcgggaatctgccttccggaaggggagattggttttatcgctctgcatatccattcagcgttgacaaaccgtccgctgtccgaggtcaatcagcactctcagctcatggcgcagcttgtcgaggtgattgaagactcatttcaaatgaaagtaaataaggaaagtgtcaactatttgcggctgatccgacatatcagatttacaatagaaagaattaaaaaagaagaaccgactaaagaaccagaaaaattaatgttgttattgaaaaatgaatatccgctatgctacaatacagcttggaaattgattaaaatcttgcagcaaacattgaagaaaccagttcatgaggcggaagcggtttacctaacgcttcatctgtaccgattaaccaataaaatttcataaattcagtttatccttataacgtgttactgattcgatcaggcatgagtgattgagggaaaaaaacgggaagttcattctcgttcttttgcgcacccaattttgctcatgcctttttgttgtgtaaaagggcaaatgtaaacggttaaactggaaggcttacgcctgtgaattcgttgtcatgatttttagctgtaaggtcagactagtaaaaagaggaggtcaattcttatgtttaaagcattattcggcgttcttcaaaaaattgggcgtgcgcttatgcttccagttgcgatccttccggctgcggggattttgcttgcgatcgggaatgcgatgcaaaataaggacatgattcaggtcctgcatttcttgagcaatgacaatgttcagcttgtagcaggtgtgatggaaagcgctgggcagattgttttcgataaccttccgcttcttttcgcagtaggtgtagccatcgggcttgccaacggtgatggagttgcagggattgcagcaattatcggttatcttgtaatgaatgtatccatgagtgcggttcttcttgcaaacggaaccattccttcggattcagttgaaagagccaagttctttacggaaaaccatcctgcatatgtaaacatgcttggtatacctaccctggcgacaggggtgttcggcggtattatcgtcggtgtgttagctgcattattgtttaacagattttacacaattgaactgccgcaataccttggtttctttgcgggtaaacgtttcgttccaattgttacgtcaatttctgcactgattctgggtcttattatgttagtgatctggcctccgatccagcatggattgaatgccttttcaacaggattagtggaagcgaatccaacccttgctgcatttatcttcggggtgattgaacgttcgcttatcccattcggattgcaccacattttctattcgccgttctggtatgaattcttcagctataagagtgcagcaggagaaatcatccgcggggatcagcgtatctttatggcgcagattaaagacggcgtacagttaacggcaggtacgttcatgacaggtaaatatccatttatgatgttcggtctgcctgctgcggcgcttgccatttatcatgaagcaaaaccgcaaaacaaaaaactcgttgcaggtattatgggttcagcggccttgacatccttcttaacggggatcacagagccattggaattttctttcttattcgttgctccagtcctgtttgcgattcactgtttgtttgcgggactttcattcatggtcatgcagctgttgaatgttaagattggtatgacattctccggcggtttaattgactacttcctattcggtattttaccgaaccggacggcatggtggcttgtcatccctgtcggcttagggttagcggtcatttactacttcggattccgatttgccatccgcaaatttaatctgaaaacacctggacgcgaggatgctgcggaagaaacagcagcacctgggaaaacaggtgaagcaggggatcttccttatgagattctgcaggcaatgggtgaccaggaaaacatcaaacaccttgatgcttgtatcactcgtctgcgtgtgactgtaaacgatcagaaaaaggttgataaagaccgtctgaaacagcttggcgcttccggagtgctggaagtcggcaacaacattcaggctattttcggaccgcgttctgacgggttaaaaacacaaatgcaagacattattgcgggacgcaagcctagacctgaaccgaaaacatctgctcaagaggaagtaggccagcaggttgaggaagtgattgcagaaccgctgcaaaatgaaatcggcgaggaagttttcgtttctccgattaccggggaaattcacccgattacggatgttcctgaccaagtcttctcaggaaaaatgatgggtgacggttttgcgattctcccttctgaaggaattgtcgtatcaccggttcgcggaaaaattctcaatgtgttcccgacgaaacatgcgatcggcctgcaatccgacggcggaagagaaattttaatccactttggtattgataccgtcagcctgaagggcgaaggatttacgtctttcgtatcagaaggagaccgcgttgagcctggacaaaaacttcttgaagttgatctggatgcagtcaaaccgaatgtcccatctctcatgacaccgattgtatttacaaaccttgctgaaggagaaacagtcagcattaaagcaagcggttcagtcagcagagaacaagaagatattgtgaagattgaaaaataagggtgttagtacgccgtgcttgtcagatgacaagtacggttgtatgatataatattgtgaagtaattaagctttaagttaaaaggagaatgataaaaatggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaatgcaagaattaaaagggattggcgcttcagccggcatcgcgattgcaaaagcataccggcttgaagagccagatttaacggttgaaaagaaaaacatctctgattctgaagcggaagtaagccgttttgatgaagcgattgcacgttcaaaagaagagctcgaaaaaatcaaagagcacgctttgaaagaactgggtcaggataaagctgatattttttctgctcaccttttagttctcagtgaccctgagcttctgaaccctgtgaaagaaaaaatcagcactgattcagtgaacgctgaattcgctttaaaagaaacgtcttctatgttcgttaccatgtttgaatctatggacaacgaatatatgaaagagcgtgcggcagatatccgcgatgtaacaaaacgcgtaaccggccacctgcttggcgtcgaaattccaaacccaagcatgatctcagaagaggttattattgtagctgaagacttaacaccgtctgacacagctcaattaaaccgtgagtttgtaaaaggattcactactgatatcggcggacgcacatctcactctgccatcatggcacgttctcttgagattccagcagttgttggaacgaaagcggctacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagacggacatcatgtagagcttgcagcgaacatcggtacccctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcggacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagagaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgatccaatacacaatggcagctgaccgtatgaatgaacgtgtatcttacctgtatcagccatacaacccggcaatccttcgcttaattacactggtaattgaagcagcacacaaagaaggaaaatgggttggcatgtgcggagaaatggcaggagacgagattgcgattccgatccttctcggcttaggcttagatgagttctcaatgagcgcaacgtctatccttccggcaagaacacaaatcagcaaattgtctaaacaagaagctgagtcattcaaagagaaaatcttatctatgagcacgacagaagaagttgtcgcgttcgtaaaagaaacattcaagtaatgtacaaaaaccagacggcctccggcctgtctggtttttttcataagtaagggtatagaaggacacaataacatggctaggagggatagtatgtcaaaccaatttaacgcaggagatactgtttatgtgatctacagaaatccgcacgccgccaatgtagcccacataaaggaagccgaaattgtgcaccatccataccatgaaggcgagctttccctgtttatttatgaaacctatcatccgttcgcagaggacgatgctgtgtttgcaagctatgaagaagctaaatcgctttacaaagaactctttgatattgatccgtatgagtaacaaggaaatcattacaactcatatcctttccgcctagtgagaaaagtaacgttagtaaaggaaaaggatgtggcatcatgcagaacccatttgttccgcagcttgtatatatagaaccgagggcgctggaatatccactaggccaagaattacaagataaatttgagaatatgggcattgaaatcagagaaacaacatcccacaatcaggtgcgtaatattcctgggaaaaatcatcttcagcaatatcgcaatgcgaaatcaactttagttatcggtgtccggaaaacattaaagtttgattcatccaaaccctcggccgaatatgccattccgtttgcaacaggctgcatggggcattgtcattactgctacctgcaaacaaccatgggatcaaagccgtatatcagaacttatgtaaacgtcgaagagattttggatcaggcagataagtatatgaaggagcgcgcaccagagttcacaaggttcgaagcatcatgtacgtcagacattgtaggaattgatcatctgacacacacgctgaagcgcgccattgaacattttggccaaagtgatctcggaaagctccgatttgtaacgaaatttcatcatgtcgatcacctattagacgcaaagcataacgggaaaacgagattcagattcagtattaatgccgactatgtgattaaaaactttgagccgggaacttcacctcttgataagcggatagaagcggcagtaaaagttgcaaaagcaggctacccgttaggctttattgttgctccgatatatattcatgaaggctgggaagaaggatacagacatctgtttgaaaagcttgatgctgctttgccgcaggacgttagacatgacataacgtttgaattaattcaacaccgttttacaaaaccggccaaacgagtgatagagaaaaattatccgaagacgaagctcgaattagatgaagaaaagcgccgttataaatggggccgttacgggatcggaaaatatatttatcagaaagatgaagagcatgcacttcgagaagcacttgaatcctatattgatacctttttccctaacgcgaaaattgaatatttcacttaaacgggctgttgtgatcaacagctctctttttataaaaaggatttttccattccatcaaaacgccgtaattcaatgattctttatcctctacataattgctgactacacgaataggtgaacgcccgcaacggaggagaaaggacagcacagggtcgtttttcctgccttccatcacatcttcaacgtactgaacagcgctgatctcgtgtgcgtatttatgatataaaggaatgcggccgccgccgagaaggcgctccagtctcttatcaacagtcagctcatacatcgtattcatcagccattttccgattccaagctttcgataatgaggagaaacagaaatatccactacatataaagtatttccatgaggttcatggtttttaatcgatccgttgtctgttgcttgtgcccatgtatgatcaggagattcaggctcaaattgtacaataagagcagtcatggaaccgataattctgccattgatgagcgcgcataaagcgccttctggaaaggttttgatatagctggcaagctggtcctctgaccacagcaattcctggggaaacggaggagggaaacattctttttgaagagaaatcagcctctcgatgtcagtctcagtgtagtttctgatggtcagagcctcaaattttctgccgtcgtgcacatacatttgttttagtatgatcatcactctccttatgttgtttcattataacgaagattgaattttcagtaaatatattccggttttcttataatttattttttgattattcatttttcaaacgaaagggccgatatagaaattaggaggggattggtttgtttaaaaaacttcacatgaagattgctgtttttgtttcgattatgttaatcgtcacagttgttcttttaatgctgtcttcttatttgacgctaaaaccgatgattacagaggatgggaaaaatacaactcaaaacgtgacgcagtcacttgaacaaaatattgcattgcaattaaagagttatgccatttcgttatcaagattggctaatggggaattaacgcatacatttataacgaaaccaagtaaagaagcttctcggctgtttcacgatgacattaagcaaatcaaagaaaacgatgattatgttgcgatggcttacataggcaccgcaaaaaaagaaatgtttacatatccaaaagcggatttcgctgaggattatgatccaacatcaagaccatggtataagcttgcagctgaaaccccggatcaagttgtttggacggaaccttataaagatgtcgtgacaggagacatgattgttactgcatcgaaagcgatcttagacgggcaaaaagtgataggggttgccagctatgacttgaaactctctgctatccagagtatggtcaataaacaaaaggtgccttacaatggatttgcctttttagctgatacgagcggcaatcttttagcccatccgtcaaatcaaggaaaaaatatatcaaaggatcaaacactgcaaaccatcgcatccgagaaacaagggatacaagatgtgaatggaaaaatggttgtgtaccaaacgattggcgaaacggactggaaggtcggaacgcaatttgataccgatcaattaatgtggatttcagataaaatgaatcgggcaaatctttggatatcattgcttgcgcttatcataacaattattctcagctacttcctggccaaaacgataaccggtccgatacagcagttgatcgcaaaaacgaaagctgtttccgcaggcgatttaacagtgcgcgcggaatcaaaatctaaggatgaagtcggtattttaacaagagatttcaatctgatggttgaaaatatgaaggaaatggttgagcaagtgagactctcttcagggaaagtatctgacacctctgaacaactaacggctgtctctgccgaaacaaatgaaacaagcggacaaattgcaaaagcgattgaagaagtagccgcaggggcatcggaacaggcttctgaagttgaaaccattaatgaaaaatcggaaagcttgtcaacgaaaatcaggcaaatcgctgaggaggcaggcggaattaaagaacgctctaaatcgtccgaggatgcaagctataaaggacttgacgcgctcggccagctgctgatgaaatcaaacgaagccaatatggaaacgaaaaaggttgaaacgatgctgctggatttggaaaatcaaactaagaatattgaagaagtcgttacagcgatttcaaacatatctgatcaaaccaacttgcttgccttaaatgccagtattgaggcagccagagccggagaaagcgggcgcggttttgccgtcgtagccgatgaagtgcggaagttagctgagcaatcagccctttctacaaagcatatcagcgagactgtgaagcttatccagcttgagacaaaagaggcctctcacgcaatggttgaggcaagcagaatgaatgatgaacaaaatagtgccattcacgaaactggagaggtattaaatacgataactgcagaaatgcagtcactggtacaaggtattgatcacatttacgcggaaattcaaagaatgagtgaagaacagcttgcgatatctgaagctattcaaagcatttcagccatatcacaggaatcagctgccgcagcagaggaagtgaacgcatcaaccgatgaacagcttgtcacccttgataaagtcaaacactcaacggaaacactaaaacatgcaagccaagagcttatgaacacaattgcaaaattcacattgtaatccaattacatccccaaacatcatttgttttggggattttttattttataagatgaatagatatggtagtctagaaaatgaaggaaaaatgataaattttaactaaaatctaaacgaaacatctgggaggaatgaccttgaaaaaaacaattggttttatcggtcttggagtaatgggaaagagcatggcatcacatattctgaatgacggccaccctgttttggtgtacacccggacaaaagaaaaagcagaaagcatacttcaaaaaggcgcgatctggaaagatacggtcaaagatctttcgaaagaagcggatgttatcatcacaatggtcggctatcccagtgatgttgaagaagtgtatttcggaagcaatggaattattgaaaacgcaaaagaaggcgcatatcttattgatatgacgacatctaagccttcgcttgcgaagaagattgctgaagcggccaaagaaaaagcattgttcgctttagacgctcctgtttccggtggagacgtcggtgcacaaaacggaacactcgcgattatggtcggtggagaaaaagaagcttttgaagcctgcatgccgattttctctttaatgggagagaatattcagtatcaaggaccggctggaagcggacagcataccaagatgtgcaatcagattgcaattgcagccggtatgatcggtgttgctgaagcgatggcttatgctcaaaaatcaggcctagagccggaaaatgttctgaaaagcatcacaacgggcgcagccggaagctggtcattgtcaaatcttgctccccgtatgctgcaaggcaactttgaaccgggattttatgtgaagcattttattaaggatatgggaattgcactagaggaagcagaattaatgggggaagaaatgccaggcttgtcgctcgcaaaatccttatatgacaagctagctgctcaaggtgaagaaaacagcggaacacagagtatatataagctttgggtgaaataaaaagactgcttgtatcctgcaggcaaccatcaggctgtcgtgaaaatctcgacagcctttttttggactataagtgcgtaaaagagaaaaataccacttgttttaaataattgacaaaaaggagacagtattttactgttgccttaacgaaaaacgaaagggtgaaaataagaacatgattctataattctagctttaagaaagaatcaatagcttaacctatacattcaacatcagtgactatttttctgatgatctgaatggcttatttgttttgtttattgatttattctctgagataggattatggggtaatgttcttattactaaagcggctttggagtgaagtcgatttagcattgcctcctatctcagaaaagtgagtataggaggctttttttgtagattattattgatgggagtattgatatgaagcttgaacagcaagaaataaatattttacattctgattctggtccatatgggatagccatttcacccgaaggaaaggtatggtttactcaacataaagctaacaagatcagctgtcttgataagacgggccaaattcaagagtatattgttccgacacctgatgctggagtcatgtgtttaacggtgtcttcagaaggtgatatttggtttacagaaaatagggctaataagatagggaaactgacagcaaaacggcaatttatagaatatccattgccgcatcaacattcagccccatatgggattacggaaggtccaggcggagatacctggtttactgagatgaatggaaatcgtataggtaaattgacatcagagggcaaaattcatgaatacgaactgcctaatgaaggatcgtacccttcttttattacgttgggttcagatcactcactttggttcactgaaaaccagaataatgctatcggcaaaataactgaatcaggtgagttaacggagtttccaattcctacaccagcagcaggaccagtaggcattacaaaagggcatgatgatgcactttggtttgtagagataatgggtaataagataggtaagattacggtttccggtgaaataactgaatatgatatccctacaccaaatgcacgacctcacgctatcgctgcaggtgtaaaatctgatttatggtttaccgaatggggggaaataaaatcggaaggctgacaagtgatcaaacaattgaggaatatacaatcaacacacctcatgctgagcctcatggaataggatgcgataatgatggcacagtttggtttgcattagaatgtaacaaaatagggaaattaaaattaactaaataatgggaaatgagctcctttgcacctcatgcgaaaccctaagttgctcaacctgactcaaaaatttctcctttattataaaaagtcaaatctatcaatggcataaatctattgcagcagctttgctattgaaggtgaaagaaaaacggatttagtgaacaagttcccctcacagccgggtgaagaagactgccttaacttaaccttgcttggctgggggtctggcagcttttttctgtttctccatacatttagatgaatacaacaaaaaagcttgtagaaaaaacatggttttctctacaagctgaagattacctgtatcgtacagggaattttttttgttattttccgatgaattgttgtgtccagatgcttccagactcaacgtagccaacaccgatgtgagtaaagttagggtttagaatgttttttctgtgtccttcactgttcatccaagcttttactacttcttctggtgtcttttggcccttcgcaatgttttcacctgctgttttgtagctgattccgaaagatttcatcatatcaaacggtgagccgtatgttgggctttggtgatcaaagtagtttttgtccttcatatcctgagattttgcgcgtgcagatttgcttaacgtttcatcaatttgaagcggctttaatccttgtttttgtctttctgcatttgtaagttcaacaacttttttctcatatgcacttacagatgaaggtgcagatgttgttgtgtttgttttttcagcagttgcaggtgctttagaagcagtgttttgatcagcagctgctttttcagtagtcttttgtgcaggttttgccgtttctgtcttttgaacatcctgaactttcacgttagattgcttcgcatgtttttgaagaagctgcttaatctctttttcgtttgcagcgtttaacgttttgatatttgtgttaatatgcagttttttcactgcatcgttaagtgacatgttttgtactgtgttccccgtttttactgtaaccacaggctggcaggagagttctttcgctgatgcttgctgtacgccccgaatgtgaataagccaaccgcagcggcagcagataaaataaatgctttcttcattagttcgtaacctcctagagttgtttgtttctacagaaaaatcataacatagcttttttgtcataaaggttccagcactttcctttgacaaatagagattgtcattttcgtaaagtaaatccgttgaatcactaagaataagggaatcagcggtatatatgattttatcgtaccgttacatatcttccttttttttgaaccgttagttatattttaatgtgtttttatattgacagctttttttactccttttcgctgtaacaactattacaaaggtgttacaattaatctcagtatatgtaaatatattgaatgatttgagaggggtaaccagaagtgactgaaataggacgtgaaccaaagaaaaagagcaaaggaaacagagcaatcagaatgaacctttttttcctagctgtctttgttctattcactgcattaatttttaagctcggggttgttcaaattgttgaaggcgaacagcatgaagaagacgctgagaaatcaaatgcaaaaacagcttactatcctgcgcctcgcgggaagatgtacgacagaaaccagaaagttgctgtcgacaaccagagcgttccagaaattgtgtatgtatcaacatctagcacaaaaacagaagataaaatcaaaacagcgaagcggcttgcttctttcattcatattgatactgaatttttgaaggaaagggatcttcgtgattactggatcgcagctcatccgaaaaaagccgccgctctgcttaaggaatcagaaagcaatctgaaaggagaccaggcttacaagcttcaaatagagcgtgttccggatcaagaattaaaggctattcagcaagatgacgaagaaatggaaactgctgcgatatatacaaggttttcaagcggaaatgcttacgaacctcaaatcgtaaaggcaatgaatccaaataagagcaatagcaatggaaaaaacggagcgctgcttgatgagaagaaaaactcctcgcaaagaccaaaaaatgacttaacatatgatgaaatttccattgtttctgagcatttagaagaacttccgggaatcgatatcgtaaacgattggacacgaaaatatccttatgacaaaaccctttattctgttttcgggggcgtcacgacacctgatcagggcctgctgagcgaccggaaagatttctacttaacaagaggctatgcgaataatgacagggtgggaaaaagttatttagagtatcaatatgaagaatatttaaattcgcataaagaaaaagtggaatacgtagaagataataaaggaaatgtcgtcagccaaaaaaccattgataaaggcagcaggggatacgatcttcagcttgcttttgacatggagcttcaggcaaaggtagaaaagatcattgaagaagaagtaagaaacagccgtgcacgcggaaattacatgcttgacagagcctttgccgtgatgatggacccgaataacggcgatattttatcgatggcagggaaaaagatagatttaaaaaccaacaaaattgaagattatgcgataggggcatttaccacccaatatgaaatgggatcagcagtaaagggggccaccgtgctagccggctatcaggacgggatcccgcattataaatattttgttgatacacctctttatttagcaggatacggtaacaaaccgaagaaatcctacatgaacatgggaaccatcaatgaattaaccgctctgcaaaaaagttcaaacgtatatatgtttaatgttgccatgcacattgccggtgtcacatacaagccgtatggacctcttcctgctgaccagaaggatttaaacaaaatgagaaattactacagccaatttggcctgggagtaaagacaggtattgatcttccgcaggaatcagccggaatgcaaactacacctgatgcggtaggggggttaattttagacttggccattggacaatacgatacatatacaccgcttcaaatggcacagtacatctcatcaattgccaatgggggctaccgtgttcagccaagaattgttacaagtatccatgagcccagcaaaaaagaaggccttgggaagaccattgaacaaagaaagccaaacattctcaacaaaattaacaactcagaaagtgacattcagcaggtgaagaccggaatgaagctagttaccacttcagggacagcaaaaaatacgtttacagaagatgtatcagggaaaacgggaacagcggaaacattttactacggcacgaatcgcaactggtggggggaaaaaacatacaatctgacttttgtcggctattacccatcgaaaaatccaaaagtggcttttagtgttgttgttccatcagtaaatgatgatgataagatcaataaaattattgccaaaagagctatacacgcctacgcagagctcgaaaaaaaacacagtaaaaaataaaaaacagggtgcacaacgaaaagattgtgtgccctttcttttattcaaaaattgacgttcaccataagaatagaaggagaatactcattttctagcgaatcatactaggtaaaagtcaatctgtatatgtcgaaacacgatgatcatgcaaaggagggattctgtggaacaggatacgcagcatgttaaaccacttcaaacaaaaaccgatattcatgcagtcttggcctctaatggacgcatcatttatatatctgccaactccaaactgcatttgggctatctccaaggagagatgatcggatcattcctcaaaacgtttctgcatgaggaagaccaatttttggttgaaagctatttttataatgaacatcatctgatgccgtgcacctttcgttttattaaaaaagatcatacgattgtgtgggtggaggctgcggtagaaattgttacgacaagagctgagcggacagaacgggaaatcattttgaaaatgaaggttcttgaagaagaaacaggccatcaatccctaaactgcgaaaaacatgaaatcgaacctgcaagcccggaatcgactacatatataacggatgattatgaacggttggttgaaaatctcccgagtccgctatgcatcagtgtcaaaggcaagatcgtctatgtaaacagcgcgatgctttcaatgctgggagcaaaaagcaaggatgctattattggaaaatggtcctatgaatttattgaagaagaatatcatgatatcgtgaaaaacaggattatacgaatgcaaaaaggaatggaagtcggaatgattgaacagacgtggaaaaggcttgatggcacacctgttcatttagaagtgaaagcatccccgaccgtctacaaaaaccagcaggctgagctgctgctgctgatcgatatctcttcaaggaaaaaattccaaaccatcctgcaaaaaagccgtgaacgatatcagctgctgattcaaaattccattgataccattgcggtgattcacaatggaaaatgggtgtttatgaatgaatcgggaatttccctgtttgaagcggctacctatgaggacttaattggcaaaaacatatacgatcagctgcatccttgcgatcacgaggatgtaaaagagagaatccaaaatatcgccgagcaaaaaacagaatctgaaattgtcaagcaatcctggttcacctttcagaacagggtcatctatacggagatggtctgcattccgacgaccttttttggtgaagcggccgtccaggtcattcttcgggacatttcagagagaaaacaaacagaagaattgatgctgaaatcggaaaaattatcaatcgcagggcagctcgcggcgggaatcgcccatgagatccgcaaccctcttacagcgatcaaaggatttttacagctgatgaaaccgacaatggaaggcaacgaacattactttgatattgtgttttctgaactcagccgtatcgaattaatactcagtgaactgctcatgctggcgaaacctcagcaaaatgctgtcaaagaatatttgaacttgaaaaaattaattggtgaggtttcagccctgttagaaacgcaggcgaatttaaatggcatttttatcagaacaagttatgaaaaagacagcatttatataaacggggatcaaaaccaattaaagcaggtattcattaatttaatcaaaaatgcagttgaatcaatgcctgatgggggaacagtagacataatcataaccgaagatgagcattctgttcatgttactgtcaaagacgaaggggaaggtatacctgaaaaggtactaaaccggattggagagccatttttaacaacaaaagaaaaaggtacggggcttggattaatggtgacatttaatatcattgaaaaccatcagggagttatacatgtggacagccatcctgaaaaaggcacagcgtttaaaatttcatttccaaaaaaataaaacaacggcttaaacgccgttgtttatcgtctgcatggcttcacgtttttttaatacaaataattctaaacggtccaggccttctctcagcgtgtccagcgagtacgcaaaagacaatcttacatatccttcaccatatgttgagaacgagctgcccggcacgagtgccacaccagcgtcttccaaaagagccatactaaaatcaaatgaagtcattccaaatgatttaatagaagggaagatataaaacgcaccggacggtttaactacgtcaagtcccatggaaacaagacggtcataaacatagtccagacgttttttgtattgttctctcataatcaatgcgtcgtcaaagccgtttgtgacagcttcaagcgcggctttttgagaaatggatgaggcgcacgacacattgtattgatgaacctttaaaatgtgctttgcaatgtctttcggtgcgaataaaaatccaattctccaaccggtcatgctgtgtgattttgacaagccgttaatgacaattgtttgatcccgcaaatggtttgcgatggagtaatgcggtctgtcatatgttaattcactgtatatttcatcagacaatacgaagacatttctgccttttaaaagggctgcgatgcttttcagttcttcttcagataaagtcacgccggtaggatttgacggataaggaagcacgacacacttggtgttgggtgtcagagcatcttcaatcagccgggcggtaagcttaaagccgtgtgacgtagtatcaacaatgacaggcttggccccgcacaaattgataataggttcatagcccggataaataggccctggcataatgacttcatcaccgggagataaaatcgtccggaatgcagcatcaatggcttggcttgcgcctgttgtgatgataatttcagattcagcatcatagttgaaatccgcttttttcttcatataaagctgcacagcttgtctcagctccaggtagccggcattcggagtatatgacgtcacgttttcatcaatggctttttttgcggcagctttcacatgatgcggtgtgaaaaaatcaggctggccgattgtaagtgaaatgacgtcttcgtgttgggctacaagattcgagaatttgcgtattcctgaaatttcgatctctcttgctttcggattcagcaaatgttccataattcatcaccttaacaaatataatgagtttatcctattttaccactagctgatcatttgtcacctttttaactgatatatttcgattgtatgcgccttttttctaaacatacctttcttttcagaaaaaaagaagacaaccagcgatttgattgtctttattgtatcatgttctattattgtttatatgtgccaatttcattaatagccataatcaaaatgaaggtcttcgtgccaaatcagatacggaggatgctcttcttgaaggtcagctgattctttcttcatattcaggtaagtttcttcactgatatcctctaaaacagtcatttcgttttctttaaatattactaaggtacccattatttacacccttctttggaaaaatccttgactattttatcactgttagttggaaagtcaatggttattaggaaaaaagtttcttttttgaggaacgcggcttgttgccttcggaattcgattttgaagagctgccattcactttttacaaattacgccgatatatacagtacaatactgaatgcgaatagcgagggattgaattgtcgttacaacaatacgaaattttattggattctggtacaaatgaattagaaattgtgaagtttggcgtgggtgaaaatgctttcggaattaacgtcatgaaggtaagagaaattattcagcctgtcgaggtgacatcagtgcctcactcccatcagcatgtagaaggaatgattaaactcagaggagaaatcctccctgtgatcagtctcttctcattttttggagtagagcctgaaggatcaaaagatgagaaatatatcgtgactgaatttaataaacggaaaattgtttttcatgtcggctctgtttctcaaattcacagagtatcctgggaagcgattgaaaagccgacatcgttaaatcaaggaatggagcggcaccttaccgggattattaagctcgaagacctgatgatctttttgcctgactatgaaaaaattatttatgacattgaatcagattcaggtgttgacacgtataatatgcacaccgagggcttcgatgaaagaagaactgataaaaagctaatcattgtagaggactcaccgcttttgatgcgcctcttgcaggatgaattaaaagaagcagggtacaacaatatcgcttcgtttgaaaatggaaaagaggcatatgaatacattatgaaccttgctgaaaacgaaactgatttatcagaacagattgatatgatcatcactgatattgaaatgccaaaaatggacggacacaggctcacaaagctgctgaaggaaaatccgaaaagctcagatgtgccggttatgattttctcatcgttaattacggatgatctgcgtcaccgcggcgaagttgtaggcgcagatgagcaaatcagcaagcctgagatcagtgatttgattaaaaaagtggatacgtatgttattgaataaataaaaacagccgttgccagaaagaggcacggctgtttttattttaaaagtaactctcgccaagttttttaaagaccggtttatggtaagctggctgctggcgatttggcactagcggcttttctttcatgccgacatattcttgcaataggtgtttcgcttttgttaaagacatttgagctttaggatttcggtacgattgattaagtgtacctaaatgcggaagatgttcgaagtcttctttagttggaggcatgtgaaaatagtagtctccgattgagataagcacgtccgattgctgttggctgaaccttggattttttgaaaaatgaagccctattttctttcctttaccttctttgacaagcttttgcaaagcccgttttttcagcagatataggtatttagggttgggggcggtttttgcatggcggttcacagtgtaaactgcttttgaaagattttctacggttggctgcagatctttcgcatatgcatggtcgtccattatttctctcctttgctcttatcaatttctatatgtttagattatacttttttaaagttgaaatgcaaatattgaatgtaaaaatgcgcttttttctaagaaaaaaagcgcatttttaacctgcattatacagatcttgccttctttttcggctgttcttgaaatgcttcctgaacatttacttccacagcctgagcactgtattttggcagtgcaataaaataaaaaataaaaacgagcaggataataacacccatgccgtaataaagataatcaatgtttgaaacaaacttagggaataacagtgcgactaagccaagtgtcaaagactgtgcaaacatcataaaagggtcctgcatgccgcttacacgtcccatcagttttggatgaacaattttgggcatccaccctccgattgcaatgttgatcggtccgatgcacattcccagtgcaaaagctgccgcgtaatacacccataaaatattggtgtagccgaggacgaagatcagcaaacctgcaatgaaaatcggtatcgacattaaaaagtgcggcttcacttttttagagatgatcgtgccgattacgctgcccgccagcagcccaaacccgagtgcgatcgtaaatacagacgtatgccactcataacggtcaggcgccaatccatatttcattgtaaacatcggcaatacggcgaatcctccattgacaaatccaaaaatgaagaagccaaaaataagagatgccagcaatttgttttttaaaatatagaggatgccttctctaaagtcatttattgaatccttaacagaagtctttctccagctgaatgcaccgtttggctgtcgggcttcttttggaatcctgcagctgcggatcagcagcccggaaatgataaagctgacaaaatcaagaataatggcgccttcaataccgatggtgttgtacataaacgcgcctataccgactccaaacaccataaaaatgctaaaaagcatctgattaagccctgccgctttcgcataatgctccttcggcagaatggcttgtaccaaactgttttctgccggaaagaaaaactttgttacagcgcttctgataaataagatacaaaaaacaagaggaatattgccggtaaataaagtgaaaaaaagcacgacagtcaggcctgctctgatccaatcacaattttctgccaccttttttctgtcaaaccggtccgcgacgactcccacgatcagaaatacaaatatggtcggaagagaatacatcagctccgccaaggtcgtatatgaaggctggctgctgaatcggtccagcaaaaaaaaagcaaaggccatgttgcctactgtcgtgcccatttgagaagcgagtgctgcgaaaaatagacgaacaaaattacgatttttaaatatatccataaaaacgctccttaccctaaaggtcccactttatcatattataaaccgcctgtttttgaaacaaataagaaaacattaccggttaatcgtgactcttgttccgtttggcacaattgaagcaagttcgatcacgtctttgttatgcatgcgaatgcagcctttagaaacagccttaccaatcgaagcgggattattcgtcccatgtattccgtagtgctgctttgaaaggctcagccaataagcgccaaatgggccgccgggattgcgctggcggttaataatgtaaaactcgccagtaggcgtttgcgttagtattttaccaacggcgatgggataggttttcattacccgattatttaggaacagcgtaagggtcttcgctccgattgagactgcgatatgatacggaattgtataagggtccggcagtccggggatgactatggactgtcccgcagtgagccctgcctgcagtgacggattagcctggagtaatgcagccgtgctgattctgaaatcagccgcgatgctgttcagtgtatcaccttgcttcacctggtacgtaagcagtttcctcatcctccttttttacttataagtattgatgaggagcccatcctgctacattaatttgtgctttttaaggtgaagacagtgatttcaggcttggccagaaaccgcaaaggcagcctggtcatcccgaggcctcggtttacgtaaatatgagtgctgcccatttgatacattccctctgtgtagacttttccatatggaggcgtaataatcggtccgtaaaaaggcagctgaatctggccgccgtgtgtatgaccggaaagctgaaggttcacgggataatctgttgttttcaaggctgcatcaggttcatggacgagaagaatggaaaaaagcctgtcgctcagccttgaaagggtgccttcataatctgggtttcccagcattaagtcatcaagcgaagcaatctcgattttgctgccatctgcgagtgacaatgtttgatagccattgcgatataccgtgaaacctccggccgtcatcaggcttttgtaaacggcagttccatagcctccgtgatcatgattgccgtaaatacaaagcttgccgaatggagcattaagctttctcaataatggaatgactgcctggtggtgctggtacgtatcaggattatcaataatatcacctgtaaaaacaatgagatcaggtttagattcattaattgtaagaatgacagtttttaaatcttcgagagtaaagtaatcactcaagtgtgcatcgctgaactgcacgattttaaaaccgtcaaatccgtgcgggatgagagagctttttattgtgtgttcggttgtctcgatcatatgcggctcgagatacctggcatagccatatcccccgccggccgttaaagccccggcagcaagagcgccgaacattccttttagaaattgtcttctggacatctttttcatttcaaaccaacctttaatagagtttttctattatatcatctgtatctgataaaaatctcatatgagcatgtgctgacagaggcagggatataatgatagaatattattgaatgaatactcattcacaattggagggataaacatggaaaaaaaggctgtaattattaccggcgggtcaagcggcatgggaaaagcgatggcaaaaaaacaggctgaattagggtggcacgttatggtgacagggaggaaccatgaggcacttgaggaaacaaaaaaagaaattcagacctttgagggacaggtcgcttgttttcaaatggatgtccgttccgattccgccgcttcagacatgattaaagaagcgataaaagcctttggccggcttgacgcgctgattaacaacgcagccggaaactttatttgtccggcagaaaagctgacgcccaatggatggaaagccgttattgagattgttttaaacggcacatttttttgcagccaggcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgcacaaacgcgatagcccccggaccgattgaacgaacaggtggtgcggagaagctatttgaatcggaaaaagcgatggcccgcacgatgaacagtgtgccgctcggccgattgggcacaccggaggaaatcgccgctttggcagcgtttttgctttctgatgaagcatcctatataaacggggattgtatcacaatggacggagggcaatggctgaatccttatccgttttaaagaatattaatctttggattcaatgtggtataatcagacaaagatagagaagcaggtgataacatgttggatccacttgatattttaacgaacattgatgatgtccttccatattaccaggcgattttcagtgccgaggaacagaaggttgtcggatatgaggtgcttggacgaattttggcagattcagaaatccaaagtctcggacccttctttttagatgcagggatacccgaagaatataaattagaggttgataacagaattatccgccaggctcttgaccgctttttagaggcggattctgatctgctgatttttatgaatcaggatgccaatctgctgatgttggatcatggtgaaagctttctggagcttctgaaagaatatgaagcgaagggaatcgaactccaccgttttgttcttgaaattacagagcacaattttgaaggggatattgagcagctctaccatatgcttgcatactatcgtacatacggaattaaaatcgcagttgacaacatcggaaaagaaagcagcaacttggaccgaatcgcgctgctctcaccagatctgttaaaaatcgatttgcaggcgctgaaagtgtcacagccgtcaccgtcatatgagcatgtgctgtacagcatatctttattagcaagaaaaatcggtgcggcgctgctgtatgaagacattgaggcgaacttccagcttcagtacgcctggagaaacggaggccgctattttcagggctattacttagtgtctccatctgaaacgtttctagagagagatgtattgaaacaaagacttaaaactgaatttcaccaatttatcacacatgagaaaaagaaactggagaccgtctatgagcactctgaacagttttacaaacgagtgcatcaggctgtgacctctttgagaaaaaacaatctgtcttctgatgatgactttattaaaaagctggcggaagagctgacagattgcagcttcaggatttacatgtgtgatgaagaaggcgatcagctgacgggaaatgtgtttaagcaagacggagaatggatttatcagccggaatatgctgaaaagaactggagctggcgcccttattttctggagaacattatgagaatgagaaatctcagaaaaggttttttcagtgatctgtacagtgatttggaaacaggtgaaatgatcagaacgttttcatatccgatggatgatcagatgtatttatttatagacttgccttattcttatttatatgagcaggacggactgatttaacggctgaaaggccgtttttttatgaaatgaaaaaaatatcaaaaaacgattgacattgatactgagaatcattatcatttaattatagagagaagctactctctgttccccaacccctctatcagatcaagatccgaaaaaacttggcgctacccccgccaagttttttatttgtcaaagcataggacaatccaatgaaacaataaacctaactagtggtaaatgtttaacacggggagaaacattcagtgctgaacacccctgacactgctgcacgggtaaggaggaaaattcgttctgaaatgattatttatttcagttccgttgtttacctctatccagcatgactcccattgattatggccacgcgggacttcaccataaaattcaaaagaaggttttgacaaaattgcaaaaaggcattcttaatgctgccaaagattcgaaaaaaattataattgtgtgcatgacattcaaaaaaagcctcaaactaaagaaaaatagtttttttcactttttttctttgcttaaattcagcagtgaaaatgccatcctgtccgactttatggtatgatgctcaatagaacttgtattataataaatacttgttgatttgaagttgctttttgaaaggagtctttttttagaatgtcacaattaatgggtatcatcacacggctgcaaagtctgcaagaaacagcggaagcggctaacgagccaatgcagcgttatttcgaagtgaatggtgagaaaatatgcagtgttaaatatttcgaaaaaaatcaaacgtttgaactgacggttttccaaaaaggtgaaaaacctaacacatatccgtttgataatatcgacatggtttccatcgaaatctttgaacttcttcagtaagattcctgaaatagggggaacaagcttccgcctttgcaaaagtaatcgaaataaacggtaaggaacatacttgtttcatggttgtaaatccttgaaaaggagtgtcgtgatggctgattcttttctgttttataatctttcagaagcacagatgacctttcaagatgtgatggaacggcttaaagcctttgttcaaaaggacccccgttcttcttatgtgttatcgatcggaaccgattcacaggtttaccgcgattacacaaagtttattaccgcattgcatttgcatcgtacaggcaagggagcttggggctgcttgaaaaatcatacagtcgacagacccatacatagccttcgggagaagatttcgttagaaacggcgtacagccaagaaacggccgctcatattcttgatggacacttaatggatattaccgatctgctcctgccctttaccggtgagggggcggatcttacctttgaagttcacttggatattgggaaaaaagggcttacaaaagatctgatccaagaaatgactggacgtattacctccatggggattgaggccaaaataaagccggattcatacactgccttcagctatgcaaatcgtttcacaaaataatttggctgaaaaagccaaggtaaatgtcgaattatgcggttgacgtttgttatctgattacttattctagcggtagagctgaaagtaagttgtcttgctttcagaggtattcagtataaaacagggggcctgattgcgaatgagtcttatcggtgaacgatttacagaagaagaacaaaaacttctgctgaatatcctgatcaaccatgagtatgccatcgagctattaagcagtgagatcaacgatatagagacagggaccaaaaacgttgacggaaccacctacaaaaaacttgtaacgctatacgaccgatttcgatttgaaaattaatgggacaccctataattgatactccacaaagagtatcttttttattgaaaggaaacttttcgacaaatactgataaagtttatattattgcaatatagggaatgtattgatgatgaaaatgaaaaggggtcgaaaacatgataagcttacaatcagatcaacttcttgaggcaacagtcggacaatttatgattgaggcggacaaagtagcgcacgtgcaagtcggaaataaccttgagcacgcattattagtattgacaaaaaccggatacacagccatcccggttctggatccttcctatcgtttacatggcttaatcgggacaaatatgatcatgaacagtatttttggacttgagcgaattgagtttgaaaagcttgaccaaatcactgttgaggaagtcatgctgaccgacattccgcgccttcatatcaatgatccgattatgaagggattcggcatggtcattaataacggatttgtctgtgttgaaaatgacgagcaggtatttgaagggatttttacgagaagagtcgttttaaaggaattgaataagcatatacgctcgttgaataagtaggctgtacggcctatttttattatatagccagagcgaaaaaaagaaagcgcatacataatttaaacgagaatagggcttgaataagaaactaagattttattagaatgggagataagaaaaacttattgataacaaaaaggaggacgacatgcagcttcaagagcttcatatgctcgtagttttagctgaggaattaaatatgagaaaggcggcagaacggctttttgtatctcagccggctttatctcagcgcttacaaaccattgaaaaggcgtggggaacaaaaatctttttaagatcacaaaaaggattaacggtaacgcccgccggtgagaaaatcattcagtttgcgaatgatgtgacattagagcaggaaagaataagagaaaatattgacgagcttgaaggtgaaattcacggcacattgaagcttgccgtcgcctccataatcggtcagcattggctccctaaagtcctgaagacgtatgtggaaaagtatccgaatgcaaagatctcgctcataaccgggtggagcagcgaaatgctgaaaagcttgtatgaggatcaggttcatatcggcattataagaggcaaccctgagtggaaggggcgcaaagattacttaatgacagatcatctgtatttagtggatactgaaatttcctgcatcgaagatattgcccatacagaacggccgtttatccagtttaaaagtgacagcacttattttcaggaaattcagcactggtggcatcaaaaatttaaaacgtcgccgaaacagacgatattggttgatcagattgaaacgtgcaaacagatggcgctgcacggaatcggttatgctattttgccgtctgttacccttcaaaatgaagataaagtgaataaaatgcctcttttagacatgaaagggcatccgatcggtcgggatacatggttattaggctatgagcctgcctttgaactgaaacaagttcaagcttttgtacaagtgataaaggatatgctggatcaggaaaatccattttaaagacagcgaggtgctgtctttttttatttatctgttgacaatgaaaatcattatcatttaaagtgatacatatgatattgaaaatcattatcaattaatggggtgataacatggctaaagccttgattacatatgccagcatgtcaggaaatacagaagacattgccttcataataaaagatacgcttcaggaatatgcgttggatatcgattgtgtcgagatagacgatgcggatgcgtcttgtttaacctcctatgattatgtactgattggcacctatacgtggggggacggcgatttgccctacgaagcggaggattttttcgaagaggtcaaacagcttcagcttaatggtttaaaaacagcctgcttcgggtctggcgattattcttatccaaagttttgcgaagcggtgaatttgttcaatgccatgctgcaagaggcgggagctgctgtttaccaggaaacactaaaaattgaattagcgcctgaaacagatgaagatgtggaaagctgccgagcgtttgcgagaggttttcttgcatgggcagattatatgaacaaggaaaaaagccatgtttcataaaggagcaactgctgttacggcatcggcgttttctggatattttgtggcggtacaaagagaaggcatttttcattattctttggagcagggctggagaaagctttttcgtttgaaaagtaagatacactgtatcagctacatagggccttacttatttggcgttggtgaaaagggaacagtcattcgttcggctgatgaagggaaaacctggacgatgtcgagctttccgacaaatgcaacagtgtgggcgattaccggcagaaacaacgggtttgtctgcgcccacggtaagcattgtatttatgtatcggatgattttggtgtctcatggcgcgtagccaaaccttttgccgaatttcataatccccctgttatccggtcgctatgtcttcacgggggcaatctttttattggcacgcaaatacacgaatattttggcggcatttgggcttacgacattaagcgtgacaatgtccaaattgtcaaaaaagaaaaaaaccggatgacggcatccatgctcgtgttcaatgaaaattggctggtggcggcgatgggttctgtgaaaggaaagcacggtgctgtcactgtacggaatcttttgaatggtgaagaattcatcattcaatccagcatgatcagaatagaagaatcatttcttgatctttcagaggatgatggcattatatatgtcactacaacacaagatgaaaatggtttttcaagaatttaccaggttgatctcgaagcccgatcgttaaaatggttcgataccattaaggggcatggatggagagtggccaatcagaaagagaatttcttttgcgcaggcttgtatgaatgtaaatttgtccagccgtacgaagtttcagcaatgattcattagaggaggaacaaggaattggcgaagattttgctcgtttatgcaacaatgtcaggcaacactgaagcaatggcagatttgattgaaaaggggcttcaggaggcggaagcagaagtagaccgtttcgaagcaatggatattgatgatgcccagctgtttaccgattatgaccatatcataatgggaacctacacatggggagacggagatctgcctgatgaatttttagatctggctgaagacatgggggagattgatttttccggaaaaacttgcgctgtattcggttccggtgatacagcatatgaatttttctgcagagcggttgatacgctagaggcaaaaataaaagaacgcggtggagacattgtgctgccttcggtaaaaatcgaaaataatccagaaggtgaagaagaggaagaattaataaacttcgggagacaattcgcaaagaaaagcgggtgcgctgtctgatcactaactgggaactgctaaaacggctgttcctttttttcttgtctttgtatctttcctttgatacagtaatgaggtagaaaatcaggaggaggactatacatatgaaaatgatggacgcaaatgaaattatttcatttattcaaaatagtacaaaatctacacctgtaaaggtttacgtgaaaggtgagctggaaggaatcaatttcggcgaatctgcgaaagcttttatcaacggaaacactggtgtcgttttcggtgagtggagcgaaatccaaacagcaatcgaagaaaaccaaagcaaaatcgaagactatgtggttgaaaatgaccgccgcaattctgcgatcccaatgcttgatcttaaaaacatcaaagcgcgtatcgaaccgggcgcgatcatccgcgaccaagttgaaattggtgataacgcagtcatcatgatgggtgcttctattaatatcggttcagtcatcggcgaaggcacaatgattgatatgaacgttgtgcttggcggacgagctactgtcggaaaaaactgccatatcggcgcgggttctgtacttgcgggcgttattgagccgccatccgctaaaccggttgtgattgaagacgacgtcgtaatcggcgcaaatgctgttgtgcttgaaggcgtaacagtaggtaaaggagctgttgttgctgcgggagcgatcgtggtaaacgacgttgagccatacactgtcgttgcaggcacaccagctaaaaaaatcaaagacattgatgaaaaaacaaaaggcaaaactgaaatcaagcaggaattacgccagctgtaaggaaaagtttgataaaaaaggcgtggataatatatccacgccttattcgtataggcaggaggaatagaaatgaagaaagaggagctcatcgcaattcgcagagatctgcatcgtataccggagcttggatttcaggagttcaaaacccagcagtatttattaaatgtcttggaacaatatccgcaagacagaattgaaattgagaaatggcgaacagggctttttgtaaaagtgaacgggacggcgccggaaaaaatgctggcgtacagagcggatatcgatgcgctttctatagaagagcaaaccggtcttccattcgcatcagagcatcacggcaacatgcacgcctgcggtcacgatttgcatatgacgattgcactcggcattattgatcattttgttcaccacccagtcaaacatgatttgctttttctgtttcagccggcagaggaagggcctggcggtgcggaaccaatgcttgagagcgatgtattaaaaaagtggcagcctgatttcatcactgcgcttcatattgctccagagcttccggtaggcaccattgcgacaaaaagcggccttctatttgcgaatacatcagagctagtcatcgatctggaaggcagagggggacatgcggcatatccgcatttggctgaggatatggttgtagcggcaagtacacttgtcactcagctgcaaacgattatctctagaaacacagatccgctagacagtgctgttattacagttggtaccattaccggaggctcggcacaaaatatcattgcggaaacggcccacctggaaggcacaatccgcacgctttctgaaaaatcgatgaaacaggtaaaggaacggattgaagatgtggtgaaaggaatcgaaatcggattccgctgcaaaggaaaagtgacatatccgtctgtctatcaccaagtttacaatacgagcggattaacagaagaatttatgtcttttgttgctgaacatcaactggcgacagtaattgaagcaaaagaagcaatgactggggaggattttggctatatgctgaaaaaatatcccggcttcatgttctggctcggcgctgattctgaacatgggcttcatcacgctaagctgaatcccgatgaaaatgcgatagaaacagcggttaatgtcatgacaggttatttttctgtttatgccaattaagtacaaatgaaagaataaaattccataaaatgagcactctagtaaacggaggtgttcaaaaatggctaaaaaaattggaattgaacaatcgttatcagatgtagaagctgctttaaaagaaaaaggatatgacgttgtaatgatgaaaagccctgctgacgctcaaggctgtgactgctgtgtcgtaacaggtcttgataataatgtgcaagggatagccgatacggtaacacaagcacctgtcattacagcttccgggatgacggctgaagaaatttgcagcgaagttgaaagcagaattcagtaataaaaaaaccgaagcaaaaagcttcggttcttttatttattctgtttctttagggaaagcgcggtcgaacgcgttctttatttcttttctcaacactcgttcgactcgccactgttccatattttctgttttggcaatgaccctgatcacaatttcagaagtccccagttcttgaatcccgatgacatttgggccttcttttatttgtggaagagccgctgccgtctcatcacaaacctgctgtaaaatatgaatcatttcatcaatgtttctttcagccggcactttaatatcaacaagagcctgcatggtaccacgagaatgattactcacgtttgtgatgtttctgttggggatgtaatgcaatgttccgtcaaagctgcggatttgagttgttcttaagccaacctgctcgacaattccgtcaaaggtggaaacggtaatatagtctccgacatccaattgtttctcaagcaaaataaaaaaacctgtcacgatgtcactgacaagcccttgggcgccaaatccgacagccaggccgacgattcctgcccccgctaaaagagcgcttggatcataatgaaacaaatctagaaccatgacgaagaatataaaaatcaaagtataagcaaatatgttaagagtcaggcttcggagcgtatgtgcacgtcctatagacaagctattctgctcctcgaattttgcaaacagatgtttaatgattttcatgcctaatgatcgaacgataaaatagagcaatatcataatggcgagtttaatgagcagaacaccggcatttgtaatcagtcccgcccaatcatattgtttaataaagtccatgttgagctccttttctaattgatggctgcacattgaggctagttaccctgtacatgaccatgttaaacgttttattcaaaaatgtcgaagccaaagacatgcatgatttgttaaaaattgactcaggaaatctgcttttatataatggcattgcaatataactaaaaatggttaataaccctttattttcaagctatttcgacttttaagccaaacaataaattggagggatacatatggcagaacgtatggtaggtaaacaagctcctcgttttgaaatggaagcagtccttgcaagcaaagaattcggcaaagtaagtcttgaggaaaacatgaaaaacgacaaatggacagtgctgttcttctatccaatggactttacttttgtttgtccgacagaaattacagcaatgtccgaccgctatgacgagttcgaagatcttgatgcagaagtcatcggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagctccaataccaaactgttttccataacaacattggacgtgatgttgatgaaacgcttcgtgttctccaggcgctgcaaactggcggactctgtccggctaactggaaaccaggccaaaaaacactttaattctttccaagaacgaaaagcggtctagcatattcgttaggcctttctgttaaataggagggaaaagcaatgaaattacgtcagcccatgccggaattgacgggagaaaaagcttggttaaatggtgaagtgacgagagagcaattgattggggaaaagccgacgcttattcatttctggtccatcagctgccacttgtgcaaagaagcgatgccgcaagtgaatgaatttcgtgataaatataaagatcagctgaatgttgtagctgtgcatatgcctcgttccgaagatgatcttgaccttggtaaaattaaagaaacagccgctgaacacgatatcactcagccgatttttgttgacagtgaccatgctttaaccgatgcatttgaaaatgaatacgtacctgcgtattatgtgtttgataaaacaggacagctccgtcacttccaagccggcgggagcggtatgaaaatgcttgaaaaacgtgtgaaccgcgttctggctgaaacggaataggtatctgactaaatagtatttcctaaaaacctgatcacatcaggttttttatttgtgcaaaaagcaatggaagaagagtaagaagcttatttttccaaatttgggtataggaattgatgatttgtttgattgatacgctaaaaaacacagctaatttttgatgtttttcctcaattttagataaatctcatatctcgtaactcgaaaattgtagatattacactaaatttctttaaagaagtaagtaaaatatatattttcaacattataccaaataaactagaaagacccttgaccccttgagaacaaaggactcttttgaaaaataaaactttttcagaaaataaggaatttttcatagagtaaatataatagtaaaatgctaaaataatagttgataaaattacttttgtaatctaatatcttaattaaagatgttaattttgatagggggtacattgaggaatgtttaatgaaagagaagctttgcgcttgcggttagaacaattaaatgaagctgaagtgaaagtcattcgtgaatatcaaattgaacgtgataaaatatacgcaaaattaagagagctggacagaaatggaagcccttccgaaatcaaaaaggatttccgttctgaaaaaaaacctgactctctgccggttctcgctgagcttgcggctcaggaaatcagaagctatcagccgcaatcacagcagcagtctgttcagcctcagcttcaatctatttcctctcttcctgccggtataccagacggaacaacacgaagaagaagaggaacggcaagaccgggatcaaaagcagctaagctgcgtgaagctgctattaaaacattaaaacgccacaacgcggcgattaagagctcggagcttcaaaaagagattgaaaaagaaagcggtcttgaaatccctaatatgacaacgtttatgcaaagcttaattaaaatgtacccggaagtgaaaaagccatatcgcgggcagtacattttagagggtgaaatcgaatctgcagaatcagcaaacgagtaaatataaagaaaaactgcttggcatcgctcaagcagtttttttattgaggttttttctgtgaaggtttgttttctttttcaagattaagcttatacacccacttttgataaggcttttcttcagcggctctgtttttcagctcttcgattgtatggctcttggcctggtctgatgattgggcgtgggcaagctgtttttgaagcacatgtatctgtttggtgacatcttcaaggatggtctctacatgatttggctgcgcgtataccgctggagcttcttcttccgttttttctttttgttttgtgccgccatcaatatcggcaaaatgagaagcaatccaggcatcgctttcatcaagctgccgtttatacgatataatagtttcgtgaaataatttttctttcgttttttctatgtctagcagtctttctttcgtttctatgattcgatctttcatatgatcaacttctattttaatatgttttagctgatattctttttctaccatttgctcttttagacgcccgttttcggcttttatcaattcggcttgctgttttgcctgaagcagtgcattttgttcctgctcaattgaggcttgaagttcgctgatccgtttatgaagatttttattttcttcttcgattttgactttagcaatatgaagtttatgtttttcttcgatttcggctctgcgtttataggtttcagcagatagaagctcctgcaaaacaacgattttatcaagcagttcagctcttatttggtgcagggtttggctggtgtgggaggcatgtttttcttttgttgacatatgtgttaattcggcagacagctgctggagcttttctttcatatcgttattttctttgagcagtttgttatttttctgatgaaagtagcttgcttcaagttcagaaatcagcttatggcaccttgaaagctcggattttaaataaaggttctcctgagacacgtcgtggaaaaaaggacctgatcttttcattcgaaccatctccctcatgatgttaacactacaatatgcaaatactgaacagctattcctctttaataaacagacaagcagtagcgttgagcctttgcttttgctatgcttttaacgaaactagaggtgagatgatatgaaggatgtaaacgtactgctggcagggggagcctcgcggcgatttggagaaccgaaggcgtttgtcaaatggaagggcaggatgctttacgaatgcgctaaagaggcacttggagaacaaacggttatcatcagccgtcccgaatttattgatagatttcaagaaaacggtgaaaatgaagtgtatcaagatgctaagccatttcaaggcatggggccattggctggtatatataccgcttttaaaaagacaaacggtgatctttatactgttctttcctgtgacacaccgctgatacaaagaaggacgatgctggagctcaaacgtctgatgactgccggtgcggacgcggtagtcccaatttcagacggacaagtgcagccattgattgcgatttaccacaaacgtatcatgccagttctatacgatcagctttctgagaagaggttgagaatatcagatttattaggcagaatttcggtttgttacgtacaggctgaaaatatcggagcaaacccggcagagtttatcaacattaatacacgtgatgattttagctgtttggaagaaaaatcgaactccctcaagcgggactgacggggcaataacatgataagatgacataaaagataaggagaacaggtttgatggaggaacgttattcacggcaaatcagatttaagcaaattggggaagagggccagaaaagactggcagacagccatgtgctgattgtcggagcgggagcgctcggcactgcaggagctgaagggctttcgagagcgggagtcggtacgattaccattattgaccgtgactatgtggagtggagcaatcttcaaaggcagcagctttatacagaaagcgatgccaaactccgcatgccgaaagccatggctgccaaagagcatctatcagcgattaacagcgagatacatattgaggcgtatgttaccgaaggaacagccgaaacgcttgagccgctgattgaaaaagcagatgtcgtgattgacgcgacagataattttgaaacccgcatgctgataaacgatcttgcccagaaaacaaagacaccttgggtctatggcgcctgtgtaagcagccagggaatgttcatgactgtcattcccggagaaaccccttgtctgtcttgtttgtttgatcaaattcctgttggcggggcgacgtgtgatactgccggcattattccgcctgctgtgcatatcgtttcagcatatcagcaggctgaggcatttaagctgttaaccggccaaatagaagcaatacagcggggttttgtgacatttgatgtctggaacaattcgcatatgaagattaacgttaatcatgtacgccgtgaggattgcccatcttgcggagcaaatgcggtatatccttatcttcaggattggaatacaccaaaagctgctgtattatgcggccgtgatacagtgcaggtaaggtcagaatcattaaaaagaatcccgaaacaggaactcattaagcggctgaaaacaatcggcaaggtcgaggctaatgcgtttttgctgcatattttttacgaggatttcagaattgtcattttcaatgacggacgggcactggtgcatggaacaaatgatgtgaaagaagccaactccgtgttggcaagagtgattggactgtaacaacaggaggggtcagaatgctggagaaaagaacaccgataccggtagacgaggcagttcggcgtgtctgccattttcaaaaacaaggtgaaacagaatgggtggcgcttgaagacagccttcatcggtttttagccgaagatataactgcggatcaccacgtccctgcgtttgaccgttcgccatacgatggttttgctgtcagagcgtgcgatacggcatatgcatcacgtgaaaacccagttcggtttgaagttattgaccatattggagctggggcagtatctgaaaaagaacttggcccgtttcaggccgtgcggattatgactggcgcgcaaatccctgaaggggcagatgcagtcgtcatgattgaactgactcaaacctttgaggagaatgggaagtcatttatgtctttaaaacgccgctttcagacgggggataatatttcaaaaacaggtgaggacgctcaaaaagggagtgttttactgacaaagggtacccgggtgacaccaggagtgacggctcttttggcaacattcggatacgcatctgtgcctgtcgtgagaaagcctgtagtcgggattatcgcaaccggtaccgaattgctgaatgtcagtgatccgctggaaccgggaaaaatccgcaacagcaatgcgagtatggtatatgcgcaagcgatagaagcaggcgcaacaccgctttatttagggaaaatctctgatgaactggataaaagctttgctgcagttaaagaagcgatgaaaaaggtggacttcctgatcacaactggcggtgtgtcagtcggtgactttgactttttgcctgcgatctatgaaaaactcggagcggacgtgctgtttaataaagttgccatgcgcccgggcagcgtgacaacggtggcgcatgcaaacgatatgctgctgtttggcctttcaggtaatccttcggcatgctatgtcggttttgaactgtttgtcaaaccgataatccagacatggctgctcaatgaaacaccgcattcgatttgtgcggaagctgttttgaccaaggattttccgaagccgaacccatttacccgatttgttcgtgcgctcgtgcaccatcaggaagggaagctgttggcgacacccgtcggattagataagtcgagctccgtcacatcacttgcagatgccaatgcatttattatcctgccgggcggcacgcgaggctacgaaactggcagaacggttcaagtgctgctcatcagagaagagaatggaagtgaatggccttggtccgtcctttcccgatcgtccaagttgtaggatttcaaaacagcgggaaaacaacgtttattgagcgcattcttgaaaaagcctctgaacagggagtctatttgggctgcctgaagcatcatggtcacggcggtgaaccgcaagcgctcacggaaggaaaagacacggaccgttacaaggcggcaggtgctgatgtaacagcggtagaaggtgctggtgtgttacagctgactgcccgccgcaattgggatttggcacggctgatcgagttataccaatttctcgaaacagactgtcttctgattgaaggctttaaaaaagccccttatcctaaagtggtaattctaagtgaaaaggaagatctggaagcgctgcaagcagtaaatataatcgccatcatctatagaaaaaaagagcatatgacagagcatcagggattacccgtttttcatgcggatgatccggttgccgtggattttgtgctttcacagctgaaggaggaatctgcataatggaacggtttgagattacgaaaacacccattaatactgaagacatcatcaaaaaagtggagaaacgggaagcaggagccattacgacatttattggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtggtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacaacagcttatccgaacggaaaaccagacctaagcgagggagagcagcatgattaaaattcttttatttgcagggcttgctgaacaggccggtacacaagcaatagaaatagatatggaacaagcaaccacagatgaaataaaagcgagtctaaaagaacaatacggtcttgaatctattgatacggctatgattgccgttaacgaaagctatgtaaaagaaaatacctctgtatcttcaggtgacacggtagccatcataccgccggtcagcggggatgaaaaccggacggcatttcagccgtccggtttttctgtatttcattggcatatccccaagtatccccagcatacaatgattttctgtaagcgtttattctacatatggtactccctataaagtaagagactcattccataattagactgaaattttgaaaaataatagaaatttatttcgggtatcgatatagtaaagatgataaatgttggaaaggtgctggatatggagacatttaaaagattaaaaatgtattattggccgtatagaaaagtgtttatgtggtcgcttctagccatgcttttgatgactgcaattactgtcgtttatccgattatcctgcaaattacgattgatgagatcgtgctgggacggcagtatcagcttgcggcgtgggtcagcttaggatttattgcggtaatggttttgaaaggaacggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcatacggtctcgctgagctcattcgattcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagtccaggaaaatatcagcggcattaatacggttaaatctctttccagggaagattttcagatcagcactttcaataaagccaatgcagaatacagggcgcagtatttacaaacatcatccatctggtctgcgtatttccctttaatggagttcattggtaacatttgtattgtagctcttctctcatacggcggttacttggttatgcaaaatcagctcaatcccggcgagcttgttgctttcttcagccttgtcaattatatgatgtggcccattatgaacttaggttttgtcatcaatatgttctctcaagcaaaagcgtcaggggaacgcctgctcgacattctggaaaaagaagaagacattacagatcatcctcatgctttgcataaacaaaaattaaccggagatgtccatttcaaaaatgtttctcttgcatacgggaaagaacaaacaaacgcgctgtgcaatgtaagctttgaggcaaacagcgggaaggtaatcggactgttgggcccgacaggttcaggcaaaagctcagtgacacagcttctcaccagattttacagtcctgttagcggaatgattaccattgatcacaaacccatcacagagtattcgttaaaaacccttcgttccaatatcggggtcgtacttcaagaatccttcctgttttcatctacgattagatcaaatatttcgtatgggcggccggatgcctcaatggaagacgtcatcgaagcggcaaaaagggcgcaggctcataactttattatggagcttcctgatgggtatgacaccatgctgggagagaggggaatggggctttccggcgggcagaaacagcgaattgccattgcgagagccatttgcttgaacccgagcattttaatattggatgatgccacaagtgcagtagatatgcaaacggagcacagcatacagcttgccttaaaagaagtcatgaaaaaccgcacaacctttatcgtcgctcaccgcatttcttcactgaaacacgccgatgaaattctcgtttttaataaaggacgcattcgtgaaaggggaacacatcatgagcttcttgaaaaaggcggctactataaaaagatttacgatttgcaataccgtgatgtcaaaatgattaatgagccgcatgaggtcggatagggagggccaaatgaaacaagcgaaaaaacaggggattttagagcgtttctattactcttcagatgaaattattgaaaagccgtttaactgggctcaaatgtggcggctgctgagctatgtcaaaccatatcgaaaaacaattttgccgctttcttttctcaccgtattgattggcactgctgtgaagcttgtgatccccattctgatcggcgtttatgttcttgatcaagcgattacagggagaaactcggagctgctgattcagctcatttttattattagcggtttatatgtcctcaattacgccgccaatgtgttaagaatcaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattatcattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaatgaaagcattcagggcatccgggtcacacaggcatttacgcaggaagaagaaaacatggcgtattttgacggtgtcaatcaggagaactacgaatcatggcgggaagcaactagaaaaaatgccatgttccgtccgctggtagaaatgacgaatgcgattgggacggctgtcttgatttggtatggagccacactcatcatgaatgaaaccattacgattggcgtcttcgtttcttttgctttctatctgggaatgttttgggaaccaatttcgagactgggtcaggtctataatcagctgttaatggggatggcatcatcagaacggatttttgagtttctggacgaacagccaaatgtcaaggagaagccgaatgccattcataaggaaaagataaatggggagatcagttttgaagaggttgaattttcgtatgatgaaaaacgaaaagcccttcacgccgtttctttctctattcctgcaggctcgacgcttgcgcttgtcgggcatacagggagcgggaagacgacgattgccaatttaatcagccgattttatgatgcgaccggaggcaccattaaaatagacggtataccgattaaggatctttcccttgccagtctgcgctctcaaatcagcattgtcctgcaagatacatttattttctctgggaccatcatggaaaatattcgttttggaaggccaaatgcttcggatgaagaggtgatgaaagcgtcccaagcggtcggagcggatgagtttatttccgatttagcggaaggatacgcaacagaggtggaggaaaggggcagcgtactgtctgccggtcagcgtcagctcatttcctttgcaagagcattgctcgccgatccggctattatcatccttgacgaagcaacggcaagcattgatacagagacagaagtgaaaattcagcaggccctaaaaacgcttctgaaagggcgtacagcagtgatgattgctcacagattgtctacgatccgcgatgccgaccgcatcattgttcttgatcacggcaagaaaatagaagaaggaaaccatgagcagctgctcgctaaagaaggcgtttatgccggacttgtgaaagcgcaatacagcacagcgatagaataatatgaaaagccttcagtataaattgaaggtttttggaaatttattagaaaaacatgaaactttttaatatccttcccgtactattggttagatattctcaaggaggttttgaaatggaaacgaatgtagaaaaaaacagtggaacggcggctgaaaagccttcacttttcggagtgatcacaagtccatccgttcaatttgaaagaattagagaaaggccggctgtatggggaccgcttttgattgtcgcagcaattatcatcgtcggtgctgtgctgcaatcactcggtacggattatagtgagcttttgaaaagccaggatacgcaagggctatcagctgaacaaaaggaggctgtcgcaacaataaccaaatttggcggaatggcaggcgctattatcggcggtatcgcagcattatttattgcccctcttatttattggctctgtgtaaaagcatcaggcggtgttacgacatataaaaaaatgctttctctcggtctgtttgtctctttgattagcagtctcggattattggttaatggaatcgttgcttttacgactgacgtgaatcctctttacagcacgacgtcactggcagggattatcccatctgacggggctcttgccagcgtgttaaatacctttgaaattttcagcatctggagctttgtattattagcaatcggacttcacaaaacgggaggcatctccaaaaaagccgggtggatttcagcaatcattctattcggaattttagttgtattttcgctcttttcaggtttaatcaattctgtggcgggtgcataggctcatgaaaaaagtctggatcggaattggaatcgcagttatagtcgctctttttgttggaatcaatatataccggtctgccgctccaacaagcggcagcgccggcaaggagatacagacggggagcgttgaagaaaatgaaatctcatcaacggttatggttcctggcacgctaaaattttcaaatgaacagtatgttttttatgaagcggataaagggacattagaagacattaaagtaaaggaaggtgataaagttaaaaagggcacgcctttagtcacctatacaaatgagcagctgagcctggaaaaagaacagaaccagttaacgtctgaatccaaccggcttcaaattgaccaaattcaagaaaagttaaaagccttagacagcaaagaaagagaactggaaaaacaggtaggaaagaaagaagcagaaaaacaaatcgaatctgaacgaacagagcttcaaatgcagaaaaaaacagcggagatcgaattaaaacaaaccgagcttcagcgacagtcacttgccaaccgggtatcagatttagaagtgaaaagcgaaattgaaggcaccgttatttctgtcaaccaagaagcggcatccaaaaagtcagatattcaagagcctgtcatacatatcggcaacccaaaagaccttgtcgtctcagggaaattgtctgaatacgatacattgaaagtcaaaaaaggccagaaggtcacactcacttcagatgtaatacagggtaaaacatggaaaggcacggtttccgcagtcgggcttgttccggatcagcaggagagcgctgcggcacaaggaacagaacaggcggtccaatacccgcttcaagtgaaaataaaaggaaatcttccagaaggaaagccaggctttaaatttatcatgaatattgaaacagataaacggaaagcaaatacgcttccttcaaaggcagtcaaaaaagaagatgaccaatattatgtgtatacagtaaaagacggaaaagcaaagcgagttgatgtcaaaatcggcgaagtgacagatgacctgacagaaattaaagaggggctttcccaagatgatcaagtcattttgaatccatctgatcaggtgactgacggaatggaagtgaaatcttaaatgattcagctttctaatgtgcgaaaaagctaccagatcggaaaggaaacgtttgatgttctccattctattgatttggacattcatcaaggtgaatatgtctcgattatggggccgtcaggatcagggaaatcgacgatcatgaatattatcggctgtcttgatcggccgacttccggtacatatcaattggacggcgaagacatttcttcatataaagataaagaactggcggcagtccgtaaccggtccatcggttttgtatttcagcaatttcagcttcttccgcggctgaacgcaaaaaaaaatgtcgagctgccgatgatttattccgggataggcaaaaaagaacgtcaagagcgggctgagagagcattggaaaaggtcgggttagccaatcgaatgctccacatgcccaacgagctgtcgggtgggcagaagcagcgggtggcgattgcgagggcgatcgtgaatgagccgaaattgattttagctgatgaaccgaccggtgcgctggatacgaaaacaagcgaggcgattatggatcagtttacagcattaaatgccgagggaacgacaatcgttctggttactcacgagcctgaagtagctgattgcacgaatcggatcgtcatggtgcgtgacggaaacattgttcctgccagctccggacaaaggagtgtgggagaatgagcctgttagaaaacatcagaatggctctaagctctgtccttgcccataaaatgcgttcgatcttaacgatgctcggcattatcattggtgtaggctctgtcattgttgtcgttgcggtaggacagggcggcgagcaaatgctgaagcagtcgatcagcggcccaggaaatactgtggagctgtactatatgcctagcgacgaggagcttgcaagcaacccgaacgccgcagctgaatctacgtttacagaaaacgatattaaaggtttaaaaggaatagaaggtattaaacaagtcgttgcttcgacttctgaaagtatgacagcgcgttatcacgaagaagaaaccgatgctacggttaacggaatgaatgatggatacatgaatgtcaattctttagaaatcgaaagcggcagaacatttaccgacaatgactttctcgcggggaatagagccggaatcatctctcaaaagatggctgaagaactgttcgataaaacctcccctttaggtgaagttgtctggataaacggacagcccgttgaaattatcggcgtgctgaaaaaagaaacaggcttgctttctttcgatttaagtgaaatgtatgtgccatttaatatgatgaaatcctcttttggcacaagtgatttcagtaacgtatcattgcaggtcgaatcagcagacgacataaaatcggctggaaaagaagcggcacagctggtaaatgacaatcatggcacagaggattcgtatcaagtgatgaacatggaagagattgcggccggaattggcaaggtaacggcaattatgacgacgattatcggctcaattgcaggtatttcccttttggtcggcggaatcggtgtcatgaatattatgctcgtatcagtcacagaacggacgcgggaaatcggaatcagaaaatcacttggtgcgacgagaggacagattctgactcagtttttaattgaatcagtcgtattgacgctgattggcggactgatcgggattggtattggatacggaggggccgcgcttgtttcagccattgcgggctggccgtcactcatatcctggcaggttgtatgcgggggcgtgctgttcagtatgctcattggtgttattttcggcatgcttcctgcaaataaagccgcaaagcttgatcccattgaagcgctgcgttatgagtagcctcatgcaacatgcatgaggtttttttatgtttagtgatttctactatgaatataaaagacttttttcattaaaataagaagaaaatgtcgtacaattgtccttatttttgtcgaatttacagtttacaaaccctatagacatacgttaatatggagaaacgtgaaagattttgatagttattgaatgaatttgaatgattttagttgcctaaaccgaaaatagcgtttacaatgaaattgtattcaaaatgaatacgttttcattaggaggtgaagcatgctaactcctgaacggcatcaattgattattgatcaaatagaaaagcatgatgtggtaaagattcaagagcttataaatctgactaatgcttctgaatcaacaatcagaagagatttatcgacacttgaagaacgcggttttttaaagcgcgttcatggtggagcggccaagctttccgatatcagacttgaacccgatatgcttgaaaaatcatccaaaaaccttcacgataaactgaagattgctgaaaaagcagcttctcttttagaagaaggggattgcatttaccttgatgcaggcacgacgacattgcacatgattgattttatggataaaaccaaagatattgtcgttgtcacaaacggggtaatgcatatcgatgcattaataaggaaagaaatttctttttatctgcttggaggatacgtaaagcacagaacgggcgcgattattggaggcgcttcactgattgccatggaccagtacagatttgacaagagttttctggggacaaacggtgtccatacagaggctggattcacaacgccggaccctgatgaggcccttttaaaacagaaagcgatcaaacaggcaaaacacgcttacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatgatttacactgtaacacttaatccatctgtcgattatattgttcacgttgaagattttactgtaggaggcctgaaccgttcttcgtatgataccaagtatccagggggcaaaggcatcaacgtatcgagactgctgaaaagacaccatgtggcgtctaaagcgctcggattcgtcggcggatttaccggagaatatatcaaaacatttttacgggaagaaaacctggaaacagctttttctgaagtaaaaggggatacccgtatcaatgtaaagctgaaaactggtgatgaaactgaaattaacgggcagggaccgacaatttcggatgaagatttcaaagcctttttagaacagttccaatctttgcaagagggagatatcgttgttcttgcaggaagcattccatcttcactccctcacgatacttatgaaaaaatcgcagaggcctgcaaacagcagaacgcacgagttgttctggatatctcaggcgaggctcttttgaaagcaacagaaatgaaaccatttttgatgaagccaaatcaccatgagcttggagaaatgttcggcacgaccattacatctgttgaggaagccgttccttatgggaaaaagcttgtagaacaaggcgctgaacatgtaatcgtatcaatggccggagacggagcgcttctgtttacgaacaaagctgtttattttgctaacgtgccaaaggggaaattggtaaactcagtcggagcaggggattccgttgttgcaggtttccttgccggaatttccaaacagctgccgcttgaagaagcattccgcttaggagttacttcaggcagtgctaccgcgttctctgaagaacttggaacagaagaatttgtccagcagcttcttcctgaagttaaggtcacacgtctatagaggaggaaacacaagtgaaaataactgagcttttaacgaagcatacgataaagcttaatattgagagcaaagaaaaagaaaatgttattgacgaaatggtcactgttcttgataaggctggaaagttaaatgaccgacaagcctataaagaagccattttaaatcgcgaaagccaaagctccacgggtatcggtgaaggaatcgctatcccccatgcgaaaacggcaagcgttatcaacccggcgatcgcgttcggacgttcaaaagacggcgtcgattatgaatcattagacggccagccggctcacttagtgttcatgatcgcggcaactgaaggcgcaaacaacactcaccttgaagcattgtcaagactttcaacgctgttaatgcgtgaagaaatccgtaagcagctccttgaagctgagtctgaagatgccatcatcgacattattaatcagcacgataaagatgatgacgaagaggaagaagaagaagcggcaccagcacctgccggaaaagggaaaattttagcggttactgcatgcccgacaggtattgcccatacattcatggctgcggatgcccttaaagaaaaagcgaaagagcttggtgtggaaattaaggtcgaaacaaatgggtcaagcggcattaagcacaagctcactgcccaagaaatcgaagatgcacctgcaatcattgtcgcagcggacaagcaggttgaaatggaacgttttaaaggcaagcgcgtacttcaagttcctgtaacggcgggtatcagacgtccgcaagagcttatcgaaaaagcgatgaatcaagatgcgccgatttatcaaggcagcggcggcggttctgcagattcaaacgacgatgaagaagcgagaggcaagtctggaagcagtatcggaaacgcgttttataagcacctgatgagcggtgtcagcaacatgcttccgttcgtagtcggcggcggtattctcgttgcgatttcattcttctggggaattcactctgctgatccgaatgatcctagctacaacacgtttgcagcagcattaaactttatcggcggcgacaatgcattaaaactgattgttgcagttctggccggtttcattgcgatgagtattgcagatcgtcctggttttgcgcctggtatggtcggaggatttatggcaactcaagcgaatgctggattcttaggcggcttaattgccggattccttgccggttatgtcgtgattttactgaaaaaagtatttacgtttatccctcagtcacttgatggattaaaacctgttttgatttacccgctgttcggtatttttatcactggcgtattaatgcaatttgtcgttaatacacctgtagcggcatttatgaatttcttaacaaactggcttgaaagccttggtactggaaaccttgtgttaatgggtattatcttgggcggcatgatggcgatcgatatgggcggcccgcttaataaagcagcctttacgttcggtatcgccatgatcgatgcaggcaactatgcgcctcatgcagcaatcatggccggcggtatggttcctccgcttggtatcgcacttgcaacaaccattttcagaaacaaattcactcagcgtgaccgtgaagctggtattacatgctatttcatgggagctgctttcgtaacagagggagcgatcccatttgctgcggctgatccgcttcgcgtcataccagctgctgtagtcggtgcagctgttgccggcggattaactgaattcttccgagtaacgcttccggcgcctcatggaggagtattcgtagctttcattacaaaccatccgatgctttaccttttaagtatcgtgatcggtgctgtcgtgatggcaattatcctcggtatcgtcaaaaaacctgttacagaaaaataagaaaaaaagcgtccttggttcgaaaggacgctttttcttatccggccggcagggagcgcggttaagttatgtattttattcttttttatgataaagtaaaagaagagaaacaactgacatagcaattgtctaggaggaaacactttgaccgaggaaaaaaatacgaatactgagaaaacggcgaagaaaaaaaccaatacgtacctggaatggggtaaagcgattgtcatcgctgttctgctggctctcctgatccgtcactttttgtttgaaccgtatttagttgaaggttcatctatgtatcccacattacatgacggagaaaggctgtttgtgaataaaacagtcaactatatcggcgagctgaagcgcggagatatcgttattatcaacggtgaaacttctaaaatccattatgtaaaaagattgatcggaaagcctggagaaaccgttcaaatgaaggatgacacgctttatataaacggtaaaaaagtagccgagccttacttgtctaaaaacaagaaggaagcagaaaaacttggtgtcagtctgacaggagactttggaccggttaaggttccgaaaggcaaatactttgtcatgggagataaccggctgaattctatggacagccgaaacgggctgggactgatcgcggaagatcgaattgtcggcacatcgaagtttgtctttttcccgtttaacgaaatgcgtcaaacaaaataaaaacgccttgctggcctttggacagcaggcgtttttattttgaaaaagaagcgactaatgcaatgcataaaaccgtgatgaacactgaaccgataatagctagcacactgaagaaaaggtgaacctgtttgttctcttttccgcgcttttctaaaagccgtttagaaaaaatgtgcgaaaatatgtaaataagggctatgcctatatataagccgatatctttggcggtaaagcctgttacggcaaggtaaaagcccgtaaaaaagatcagtaagcaatattcagtaagtgttaaaagcctcaacgtgttcctccatgagagtgtgtaattttccaggcggatgcattctctctctttaattgtaacacagctggctggtttgggtgtataagtgttttctctctgttttatcagggaatcatttctcttgccctgcattcatggtatacttttattgatgatagacatgatggaggataataaatgattgctgtaaataatgtaagcttgcggtttgcggatcgcaagttatttgaagatgttaatattaaatttaccccaggcaactgctatgggttaattggtgcaaacggtgccggtaaatcaacgtttctaaaggtgctgtcaggcgaaatcgagcctcagacaggcgacgtgcatatgagtcctggcgagcgtcttgccgtcttgaagcagaaccattttgagtacgaagagtatgaagtgctgaaagtggttattatgggccacaaacgcctgtatgaagtcatgcaggagaaagacgctatttacatgaagcctgatttctcagatgaggatgggattcgtgctgctgagctagaaggtgaatttgcggaactgaacggttgggaagcggaaagtgaagctgcgatcctgttaaaaggtcttggtatctcagaagatctgcacacaaaaaagatggcagacctcggcggttcggagaaggtaaaagttctcttggcacaggcattattcggcaagccggatgttctgctgctcgatgagccgacgaaccacctggaccttcaggcaatccagtggcttgaagagtttctgattaactttgaaaacacagttattgtcgtatcccatgaccgtcacttcttaaataaagtatgtacgcacattgccgaccttgattttaacaaaattcaaatctatgtcggaaactatgatttctggtacgagtcaagccaactggcgttaaagctttctcaagaagcgaacaagaaaaaagaagagcagattaaacagcttcaagagtttgtcgctagattcagcgccaatgcgtctaaatctaagcaggctacatcaagaaagaaacttctcgaaaaaatcacgctggatgatattaaaccgtcttcccgccgctatccttatgttaacttcacgccggaacgggaaatcggaaatgatgttcttcgcgtggaaggcttaacaaaaacaatcgatggcgtaaaggtgcttgacaatgtcagctttattatgaatcgagaagataaaattgctttcactggccgaaacgaacttgctgttactacgctgtttaaaatcatttccggggaaatggaagctgacagcggaacgtttaaatggggtgttaccacatctcaggcgtattttccaaaagacaacagcgaatatttcgaaggcagtgatctgaaccttgtagactggcttcgccaatattctccacacgaccaaagtgagagctttttacgcggtttcttaggacgcatgctgttctctggagaggaagtccacaaaaaagcaaacgtactctccggggagaaaaggtccgctgtatgctgtcgaaagcgatgctttctggcgccaatattttaattttggatgagccgaccaaccatttagacctagagtccattacagcgctcaataacggcttaatcagctttaaaggcgctatgctgtttacttcccatgaccatcagtttgttcagaccattgccaacagaattatagaaattacacctaacggcatcgtcgataagcaaatgagctatgacgagttccttgaaaatgctgatgtgcagaaaaaattgactgaactatacgcggaataaaaaagcagagatttctctgctttttttgatacctaaatatgaaaggagatcacaacatgaaatttttggttgtcggagcaggtggagtaggcgggtatattggcgcacggctttcggagaaaggaaatgatgtgacatttcttgtgcgccaaaaaagagctgagcagctgaaagaaaccgggcttgccatccatagtgaaaaagggaatgtatcatttcagcctgaactaatcagtgccggagaaacagggcaatttgatgtcgttatcattgcttctaaagcatactcgcttggtcaagtgatagacgatgtcaaaccatttatccatcaggaatctgtcattatccctttcttaaacgggtaccgccactatgagcagctatttacggcattttcaaaagaacaggtgctgggcggcctgtgttttatagaaagtgctttagacaacaaaggagaaattcatcatacgagcgcatcacatcgttttgtatttggagaatggaacggcgagcgtacggagcgaataagagcgcttgaagaggcattttcaggtgtgaaggctgaagtcatcattagcgggcatatcgagaaggacatttggaaaaagtatctctttattgcagcgcaagcggggatcacaacgttatttcaacgaccgcttggcccaatcctcgccacagaagccggacgtcacacggcccaaactcttattggggaaatttgcgctgttttacgaaaagaaggtgttccggctgatccggctcttgaggaagagagctttcgtacgatgaccagcatgtcttaccatatgaagtcctccatgcttcgggatatggaaaacggccaaacgacagaaggcgaccacctgcatggatttttgcttgaaaaagcaaaacgtttatctctcgcagcaccagtattagaaaccgtttatgcgaatctgcaaatgtatgaagcagaaaaataaaaaaaggaggcgaaaaagcctccttttatttacttaaaaagcccaatttccgtttctgaagataggctctcttttcccgtctgccgtaattccgtcaatattcatatccttagaaccgatcataaagtccacgtgtgtaatgctttcatttaggccttctttgacaagctcttcacgagacatctgctttccgccttcaatattaaaggcataggcgcttccgatcgccaaatgatttgacgcgttttcatcaaacagcgtgttatagaaaagaatgtttgattgtgatataggcgaatcgtaaggaacaagtgccacttcacctaaatagtgagaaccttcatctgtttccaccagttcttttaaaatatcctcacctttttcagctttaatgtcgactatacggccattttcaaatgtcagggtgaaattttcaataatatttccgccgtagcttaatggttttgtgcttgataccactccgtcaaccccgtctttttgcggcagcgtgaacacttcttctgtcggcatattggccataaactcatggccgttttcattcacacttcccgcacctgcccaaacatgcttcctaggcagcttaattgttaaatcagttccttcagcttgataatgtaaggcagcgtaatgtctctcgttcaaatggtcaactttttcatgaagattttggtcatgattgatccacgcctgaaccgggttgtcttcatttacgcgcgtcgctttaaaaatttcttcccacagaaggtggatcgcttcctcctctgatttgccaggaaacaccttgtgagcccagcctgctgatgccgcacctacgacagtccagctgactttgtctgattgaatatattgtctgtatgtatgtaatgctttgcctgctgctttttggaatgccgcaatccgtttggaatctataccttttagcaagtctgggtttgacgacacaactgaaatgaaagcagctccatttttggcaagctcttctctgccttttgcttcccattcaggatattcttcaaatgcttcaaacggcgctaattcgtattttaatttggcgacttcgtcatcctgccaattcacggagacgttttttgcgcccttttcatatgcgtgttttacaattaaacgaacaaaatcccggacgtctgttgaagcattgacgactacatactggcctttttggacattaacgccgacttctaccgccagctgtgcatatgtatttaatttctgtgaaaatgaatccatgaatcattcctccaagcttttttctcatcatatcaaatatgatcctataaaggaaagaaggagcccaaagtgaaaaacccaaaacgacacgtcttgggttttttcaatattatggatgattcagttttacagtgccgcctgcaggcgaatggggcatatttgccaaagaaatgctcatgcctccaagaataattccgcttaaaatggctgcgatcgctactcttcttcctaaatctcttagcatctgtttcctccttaacgtttctccatttcccacaatatgaaggaagtgaggaaaaaagaagcaagaaatttgccgcgtgtgagaattttgcgggtaaagactatttaattgccttttgcagcttatcaatcacttctaaagaacggcccgtgccgattgctacagattcaagcgggttttgcgccacgtgtacaggcacgacaatctcttctgtgagccattctttaattccattaaggagcgcgccgccgcctgttaaaataacgccgcgatcaacaatatctccgctcaattcaggcgggcagtcctcaagtgtcgctctgatggcttcaaggatatgcagaagggattcacgcattgcatcttgaatttcgttggattgaagcataatggtttttggaagacctgtcacgaggtcgcgtccccgaatttccattgcctctggtatatgttcaatcagagcatggccaatttccatttttacctgctcagctgtgcgttcgccgatcagcaaattgtattttttacggacgaaagaaacgatatcctcatcaagctggtctccgccgatcctgatagaatggcaggaaacaacgccaccgaaggaaataatagcgacctctgtcgtccctccgccgatatctactaccacattggcaaccggctcatcaaccggtaaatccgctccgatggcagctgcgactggctcttcgattaaatgaacgtttttcgcgccgcaatttttcactgcgtcactgatggcgcggcgttctactgctgttgagcctgacggtgtgcaaacgactacgttcggttttctgaacgacatgccgatgctttttgcggcttttttcataatgtgctttagcagatcagttgtcatatcatagtctgcgatcacgccatctttcatcggtctgacagcgacaatttttcccggtgttttaccgatcatgtttttcgcgtcagctccgattgcaagcactgattttgtcgtcgtatccactgcgacaacagatggttcatttaggataatccctttatttttgctgtaaacaagtatattagctgttcctaagtcaatcccgatttcagttgattgaaacatgttttcacccaatctctatcctaatttaatatgattctacatttaaagtttctcagaaatactgcgatttttgggggtgtgcgtcggtaaagaaatgtttttgtaaaaaatcaaggaactgtgtaacagaagtaatacatttttcggttttatggaaaaaatatcttgtaattcttatagaaagcgggaaactttttcaaagtttcattcgtctacgatatattgaggtacatccttaaaacattacatgagaaaagaaacatttaaaggaagaagggtttttatgaaatcaataggtgttgtgagaaaagtagatgaattaggccgcattgtcatgccgattgagttgagacgggcattggatattgccataaaagacagcattgagttttttgttgacggagataaaattatcttgaaaaagtacaaacctcatggcgtttgtttaatgactggagaaatcacttcagaaaataaagaatacggcaacggtaaaattacgctaagccctgagggtgcacagctgcttctcgaagaaattcaagccgctttaaaagaataaaattatgctaaaaaaggcggagcgatatcatctccgccttttttgcgtatcaatttttgattaccgccgcctaagataagacatcaagatatttggtaatgaatgatttgggatactttacatattttactcaattatttgtcgaagaatggtacaataagtagagaaacacaagcggcaggtggtcatatgagaaaatatcaagctcgtatcatttccatcattttggcaatgatttttataatgttttgggattatttattttattttataggcaaaaacccgattaattggcctgttgatattgtgtatactgcagtcacgctggtaagtgtctggatgttggcttattatattgatgagaaacagcagctggttaagaaaatgaaggataacgaatggaagtataaacagctttctgaagaaaaaaaccgcatcatggataatttgcaggaaatcgtatttcaaacaaatgcaaaaggtgaaattacatatttaaaccaagcgtgggcatctataaccggcttttcaatcagtgaatgtatgggaacaatgtataacgattacttcataaaagaaaagcacgtagccgaccacattaacacccaaatccaaaacaaagcgtcttctggcatgtttacggcaaaatacgtgacaaagaacggcacgattttttggggagaagttcattataaactttactatgaccgggatgaccaatttacaggcagcctgggtacaatgtcagatatcactgagcggaaagaggctgaagatgagctcattgagattaatgaacggctggcgagggaatcccagaaactatcaatcacaagtgaacttgccgcaggtattgctcatgaggtcagaaaccctttaacatctgtcagcggtttcctccagattatgaaaacacaatatccggacagaaaagactattttgacatcatcttttcagagattaaaagaatcgatttagtgctcagcgagttgctgctgcttgcaaaaccgcaggcaatcacatttaaaacacaccagcttaatgagatcttgaaacaagtcacgacattgcttgataccaatgccattctgtccaatatcgtcatagagaaaaatttcaaagagacagatggctgtatgattaatggagacgaaaatcagctgaagcaggtctttatcaacatcattaaaaacggaattgaggcaatgccaaagggcggtgtcgtaaccatttcaactgctaaaaccgcctctcatgcagtgataagcgtaaaggatgaaggaaacggcatgccgcaggaaaagctgaagcagattggcaaacctttttattcaacaaaagaaaagggcactggactggggcttcccatttgtttgagaatcctgaaggaacatgacggggaattgaaaatcgaaagtgaagctggaaaaggcagcgtctttcaagtggttttgcctttaaaatcagacagctgagaggagaaaaataaagtgaactcgcttctgtttgtatacgggacattaagaaagcatgaaaaaaaccatcatttgctggcacaatcggcatgtatcaatgagcaggcgagaacaaagggaagtttgtttgctgcaaaagaggggcccacagttgttttcaatgatgaagatgaaggctatatatatggcgaagtatatgaagcagatgaattgtgtatacataagctcgatcaattttttcaaggatatcataaacaaacggtgtttgtagaaacggatgtcgggattaaaattgcgcttatttattttatgaacaaagacgggtgtgccggttttacgaaaataagcagcggcgactggaaagaacatcagatgatcagcaaatcgaaaaatcccatttattattttgcctatggatcatgcatggataatgcccgctttcaaaaagcgggagtcgatcactattttcaagatccagtaggaagagctgttttaaaaggatacacaacccgcttcacgctaaaaagggaagacggttcaagagcggacatgttggaagacggaggaacaacagaaggcgttttataccgtatcccttattctgctctctcctatctatataaaagggagggcgtcgaatctcttacgtatcggccggcatttgtagacgttgaagctggcggaaggcactacaaagactgtttaacctttctcgtcctccaaaaagaagcggaaattgccccgcctcagcactatcagattgaaatcgaacgcggagcggagctgtatttgtcgcctgagtttactgaaaagctcaagcggcatatgaattcgctgccaaaaggataacactgtaacaaaagaatatgataaaatttgatcaatatcatgtcatataaaggagcaccacgatgaaaaaagaatttgcggtaattgggctgggccgttttggtggcagtatttgcaaagcattaagcgaagaaggcgtcgaggttatggcaatggatatcgatgaagataaagtcaacgagtatgccaagattgcatctcacgcagttatcggtgattcgacagacgaatctgtcctgaaaaatttaggcctgcgaaattttgaccacgttattgtagcaatcggggaaaatattcaagcgagtattttaacgacactcattctgaaagaacttggcgtccatacgattacagttaaagcgcagaacgattatcacgaaaaagtgctgtctaaaattggtgcggatcacatcgtccacccggaacgcgatatggcaaaacgaattgcgcataatatcgtgtccaacaatgtacttgactatttggagctgtctgaagagcatagtcttgttgaaatcgtagctaacagccgcctggctggaaatacgcttctcgatttagatattcgcgcaaaatacggtattaacatcgtagccataaaaaggggcaaggaagtcatcgtatcaccgcttgcaaccgaagtcatccaccaagaagatatactcattgttattggatcagttacagacatctcccgtttcgaaaaaagagttcttcatacaaaatagcaggcaaataagccgtcctcaaagggcggtttttcatattatcagaatataacaactttaatgaactgagcgtcaatttcttaaaatttcattgactaagcacaggcgttccgatagcatattgtaccatataataaaaaaaggaggggcctatttgaataaagaagcgctagtcaataggctgaatgcttcagccaaaagacaaaaagctgatatcgtcattaaaaacggaaaaatcatggacgtatataatcaagaatggatatatgaagatattgcgattacagatggagttattgtaggcctcggtgagtatgaaggcgaaaatatcattgatgcagagggacaaatgattgttccgggttttattgatggacatgtacatattgagtcgtcaatggttacaccgattgagttcgctaaagcagtgttgcctcatggcgtgacgacggttgttacagatccgcatgagatcgcgaatgtgtctggtgaaaaagggattgagtttatgcttgaacaagctcggcatacaccgctgaatatccattttatgcttccttccagtgtgcctgccgcaagttttgagcgatcaggcgcaattctcaaagctgccgatctcaagcctttttatgaagaagaagaagtattagggctggctgaagttatggattatgtgtcggttcagcaggctgaagaagacatggttcagaaactgcttgatgcccgtgtggcaggaaaaaggatagacggtcatttagctggtttatcaacagacctcattaacatttacagaaccgcatttgtcttaaacgaccatgaagtaacatcgaaggaagaagcccttgatcgtatcagaaggggcatgtatgtcatgatgcgtgaaggatcagtcgccaaaaacacgctcaatgtgctgccggcggtgaatgaaaagaacgcacgccggttctttttctgtacggatgataagcatgtggatgatttattgtcagagggaagtgtaaaccatcaggtgaaaatggcgattcaagccggacttaatccgtttttagcctatcagctaggaagcctcaatgcagccgaatgctacggattagatacaaagggagcgattgccccgggttttgacgctgatttgctttttgtatctgatctggaaaatgtcactgtcacaatgacgatggtaaaagggcagactgttgctgaagacagcaaagcggtctatcaggatcatgcttcaactgcagcaccagatcaggcactgcttgattctgttaagcttgctgctcctcttcacaaacaggattttcatatgccaatcgattcagagcagcagatcaatgtcattcaaatcataccaaatcagcttgaaacacgattagtacaagttccggctcctgttgcccgcgaatttgagcctgacactgagcttgatttgttaaagattgcagttgtcgagcggcataaaggattaaaagaaaccggacttggtgttgtgaaaggttttggattcaagagcggagcgattgccacaaccatttcacacgactcccataatattattgccgtcggaacgaatgatgaggatatcgcggcggcagttaataagctgcaggaaattggcggaggattaacaattataaaaaatggggaagagctccattcagtaccgctgccgattgcagggttattatccgaccaatctgcagagcaagtgaatcaaagcttgctgacgcttcatgataaattgccgttaatcggtttcacaggcggatttaatccatttttgacattgtcgtttttagctttgcctgtcattcctgatattaaaatgacgactacgggattattcgatgtaaaatcatttcaacacatatcactgcaataaaaagaggcactcccttagggagtgcctcttttttttaaacctccataatgatcggcaggatcattggacggcgctttgttttttcgtacaagaaaggtgcaagagtgtctgtaatctcgtttttgatttcagaccattgagtcgtttttcgttccattactttttgtaagtgatttgaaatgagctcttgagcatcgttgatcaagtcgccagattctctcatgtacacaaatcctctggaaatcaaatcaggacccgctgaaatcttgaagtcgtccatgtcaatgctgacaacaacaatgacaagtccttcttcagagagaattctgcgatcacgaagtacgatattgccaatatcaccgataccgcttccgtcaatgtacactgaaccggacgggatttttcctgcaactgaagcctcatcgcctttaagcgctaatacttcaccattatccatgataaagcagttttcctctgggatgccacaatctgttgcaagtttgacatgcatcttttgcattctgtactcaccgtgaatcggcatgaagaatttaggcttgattaaacgaagcatcagcttctgttcctcctgtccgccgtgaccggatgtatggatatcgttaagagggccgtgaataacctcagcacccgcacgatacagctggttgattgttcgactcacgctgattgtgttgcctgggataggggatgaagaaaatacgactgtatccccaggattgattgaaatttggcggtgtgtgccgtttgcaattcttgataacgccgccattggttccccttggcttcctgtacataaaattgttactttattagcaggcatacgattgatttcgttatgctcaataaacgtatttttaggacagttaatataaccgagtgtctgtccaatttcgatagccgattccatactgcgtccaaatacggcaacttttcttccattttgtacagcagcttcaattacctgctgcaagcggtgaatattcgacgcaaatgtggcgaagataattcggccgtccaccttgcggaaaatgtcatgaatgctttctcctacacggcgctcagacatggtaaactccggattttcactgtttgtgctgtctgaaagaaggcacaaaacgccttctttaccgatttcggccattttcgttaagtttgccggctcgccgactggagtaaagtcgaatttgaaatccccagtatgtacgatgtttccgggcggcgtttttacaacaatgccgtaggaatccggaatactgtgtgttgttctaaagaatgacacagccgttttgcggaactttacaatatcatcctcgccgataatgttcagtttcgtctgtctcaataatccatgctcttcaagtttattccgaagtaagccgatcgcgagttttccgccgtatacaggaatattcacttgtctgagcaggtatggaataccgccgatgtggtcttcgtgcccgtgggtgataaaaagccctttaattttatcttcgtttttgactaaatacgtataatcagggatgacgtagtcaattccgagcagttcgtcctcgggaaacttgatccccgcatcaatcagtacaatttcatcctggaattgcaccgcgtacgtatttttaccgatttcgcccaaacctccgagggcgaaaacagcagtctgatcattttttacaaatttcataccgctcataactccaatactttaaaattttcgctctgttgttcatattctaagaatgcaccatcaacaggtgtaataaactcaatattaaatttcttttctttcagctttgttctgacgtcacgctcagatacgccttcaatataaagtgaatctgtcttttcccgaacaggtacttcgtcagccttctcttgataaaataccttataaatcattccaaatctctccttaaatgccgtatgttagactcgctcattctattatattcgaaaacggaatataaggaaagccttgagcaaaataaggatctctcaaaaagtgaaagatcccttgtcaggcaattgctttcttacggagcattccgttccattgtcttctgagtttctttcttaatttacgcagcattagccagtccctcctttaatgaaaaatttgtcccagagttcttttatacaaatagtatacggagattgaggaagacttttcgtggttattaatggaatttaatatgatttttgaacgaaattgtttgctgaatgacaatctttttgtatgatgagggtgggaattgcagaccaagacgataaaggggaagttgcgatggattctaaattaatcttttttgatattgacggcacaatatatgatcatgataagaatataccggaaagtacgagaaaaaccgtggcggagctgcagcgccaagggcatcatgtgtttattgccagcggccggtctccatttttggttaagccgattttggaggagctgggcatccactcatttatttcctacaatggacagtttgttgtctttgaaaatcaagtgatttataaaaatccgctgcctgaagatgcaatcaggcgattattaaagcaggcggatgaaggcaagcatcctgttgtgtttatggctgaggacacgatgaaagcgactgttgcggatcaccctcatgttctcgagggaatcggcagccttaaaaccgattacccagagaccgatgaccttttttatgaaggaaaagaaatttttcagcttcttttattttgtcaggatgaagaagaaaaagcttatgccgcttttcctgagtttgatctagttcgctggcatgagctatcgactgatgttctgccgcacggaggttcgaaggcagaaggaatcaaaaaagtgattgagcgtcttccgtttgatatcggcgatacatatgctttcggcgacggattaaatgatctgcaaatgattgaatatgtagggacaggcgttgctatgggaaatgctgttcccgaactgaaagaaatcgcggactttgtaacaaagccggtggacgaggatggaattgcatacgctgtcaaagaattgggccttttaaaataaagaaatggctggcattgtgccagccgttttctcttttagcgctcaattgcgattgcattttcaggttctttgaaaggattttccttgtcaatatgatcatagaacataacgccgttcaaatgatcgatctcatgctgaaacacaatagccggaaatccttttaaacgaatatcaatattttcgccttctagtgttgttccttttactctgatgcgagcatagcggggaacataaccgggaatcgcttcatccacagagaggcagccctcgccgcttgttaagtagcttttttcaactgaatggctgacgatcttaggattaaacagagcatagctgtataatttaccggaagcatcttccgcatgaacggcgatcattcgttttttgatattaatttgaggagctgcgagtcctacgccagggcgcagcttgtatttttcggctaattccggattttggctgtttttaacaaattcgatcatgtcggccagctgctgtttttctgcatcagttggaggcagctcaacaggttcggcagtctctctgagggctggatggccgtcacgtacgatgttttccatagtaatcaagaaacttcactcctaaagcttaatatgtaaattatatcggatttcttcacaaaggtgcaacgaaacgaatgaccagccgtatatggctggtcaatttcatgctgtgtggttagcaacagcctccgcctaaataagcagctccgacaatgattaacagaatgaataaaacaacgattagcgcaaaggtgcggccgtagccatatccgcagccaccatatccgtaaccaccataactgcagcagcctccgccgtaaccatatccatacatattacataacctcctcttttaattacgccagagcctttataagtaggcatagcgtctaatataacctatgtaaaaacaaaaaagttgtatggtcatctgtcctgatttttcacttttttgatttaatttcagtattgcatttatacagcacggctattgccaaatgtccccatggattctatagtagaaattgtcaagattgggggatttaacgtgaaagacgcaataaaacggcggcctggaatgaagatcggagctttttgtgccatggcactgatattaacaggatgcatgggacaggacccggttgattcacttcatcattcattagaaaaagccgcggaatcggaaaagccgtttcaagaagaacaaaacacactcaaagaattagaggccaaagaaaatcagctttacgatagtgttatgaagctcaatatggatgattataaaaaaattgttgctttatctaataaggcgcttgaaaatgtcagcaagcgcgaagaacacctaaagcgtgaaaatgacagcatgaaaaaatcggaaacagaatttgaggaagcaaaaacgtcagcggaacatattaaggaaaaagacataaaagaaaaggccgatgccgcagcaaaccatatggagaaaagatatacatcatatggcaccatgtataaagagtataaaaaagcgcttgagcttaataaaaaactgtatatgcagctgaaagacaaagacttgacaagagatgatctggatcagcagatcgataaagtcaatgcttcttatgaaaagatccttaaatatagcggagaatttaatgaacaaaccgaaaaatataataaagcccgggaagatttatatgatgctgcaggctatcgtgtgaaaaagagctgactcgatcagctctttttttgaatatatgcgatacagatttcgttcaaaattttcatttctattgtagtacagcatagtaaggtatactagtacagttttgggtgcggttggcatctgtttttttgctgaaaatgtaaagcgaatacatttattgaaaatcagcgatgaaaacgattgacggttcttctttatttggtgtaaactaatccatgttaagcggtgttgtattagttttttacaacttcgaaataatacagttcaaagcagagtgtaactatcctactaaaaggttttggcaaactggggatcggctaaaatataatacgacttactgctgatactttagggtaccctaagtttgtatgtataaaaggaatgcacgtctaatgactgtttaaaagaaaggaagaggtgacttagtatggctgcaaaaacgaaaaaagctatcgttgacagtaagaagcaatttgatgccattaaaaagcagttcgaaacgttccaaattttaaatgaaaagggagaagtcgtgaatgaagcggcgatgcctgatttaactgatgatcaattaaaagagctaatgcgccgcatggtatttacgcgtgtgcttgaccaacgctctatctcattaaaccgtcaaggacgtctcggattttacgctcctactgcgggtcaagaagcttctcagattgcaacgcatttcgcgcttgaaaaagaagactttgttcttcctggataccgtgatgtgcctcagttaatttggcacggccttccattatatcaagcgtttcttttctctcgcggacatttcagaggaaaccaaatgcctgatgatgtgaatgccctttctccacaaatcattatcggtgctcaatacattcaaactgccggtgttgcgctaggtcttaaaaaacgcggtaagaaagctgtcgcaatcacttacactggtgatggcggagcttctcaaggggacttctacgaaggaattaactttgctggagcttataaagcacctgcaatcttcgtggtgcaaaacaaccgttacgcgatttcaactcctgttgaaaaacaatctgcagctgaaacaattgcacaaaaagctgtagctgccggtattgtcggcgtacaagtagacggaatggatccgcttgctgtatacgcagcaactgctgaagcacgcgagcgcgcaatcaacggcgaaggtccaacactaattgaaacacttacattccgttatggcccgcacacaatggctggtgacgatcctactaaatatcgtacaaaagaaatcgaaaatgagtgggaacaaaaagatccgcttgtacgtttccgtgcgttccttgaaaacaaaggcttatggtctgaagaagaagaagcaaaagtaattgaggatgcgaaagaagaaattaagcaagcgatcaaaaaagctgatgctgaaccgaagcaaaaagtaactgatttaatgaaaatcatgtacgaaaaaatgcctcacaaccttgaggagcaatttgaaatttatacacagaaggagtcgaagtaagccatggcgcaaatgacaatgattcaagcaatcacggatgcgttacgcacagaactgaaaaatgacgaaaatgtcttagttttcggagaagacgttggtgtaaacggcggcgtattccgtgcgacagaaggattgcaaaaagaattcggtgaagaccgtgtgtttgacacgccacttgctgaatctggtatcggcggtcttgcccttggtttaggcttaaacggcttccgtccggtaatggaaatccaattcttcggatttgtttatgaagtaatggattcagtttctggccaaatggctcgtatgcgctaccgttctggcggacgctggacttcacctgtaacaattcgttctccattcggcggcggtgttcatactcctgaacttcacgctgacagcttggaaggtcttgttgcacaacagcctggtatcaaagttgttattccatcaactccttacgatgccaaaggacttttaatttctgcgatcagagacaatgatcctgttgtcttcttagagcatatgaagctttaccgttctttccgtcaggaagttcctgaagaagaatacacaattgagcttggaaaagctgacgtgaaacgtgaaggtactgatctttcaatcatcacttacggcgcaatggttcatgaatcattaaaagctgctgaggagcttgaaaaagacggcatttctgctgaagttgtcgaccttcgtacagtaagcccacttgatatcgatacaattatcgcttctgtagaaaaaacaggacgcgcgattgtcgttcaagaggcacaaaaacaagccggtattgctgcaaacgtagttgcagaaattaatgaccgtgcgatcctgagcttggaagcacctgtacttcgcgttgcagcgccagatacagtatttcctttctctcaagcggagagcgtatggcttccaaaccataaagacgttcttgaaacagcaagaaaagtgcttgaattttaatcaaactgcataatcgagagggaagatgaacttttccctctattatatatctgttttcaatgcttacgatgtaaactttaaaattgcttaatcaaactaggaggtcgagaactgtggcatttgaatttaaacttccagatatcggggaaggtatccacgaaggcgaaatcgtaaaatggtttgtcaagcctaacgacgaggtagacgaagatgatgtactggctgaagtccaaaatgataaagcagtagtagaaattccttcacctgttaaaggaaaagtattagaattaaaagttgaagagggaacggttgcaactgttggacaaacgattattacgtttgatgcacctggttacgaagatcttcaatttaaaggcagcgacgagtctgacgatgcgaaaactgaagcacaagttcagtcaactgcagaagctggacaagacgttgcgaaagaagagcaagctcaagagcctgcaaaagctactggcgcaggacagcaggatcaagctgaagttgacccgaacaaacgcgtgatcgctatgccttccgtacgtaaatatgctcgtgaaaaaggcgtagacatccgtaaggttactggttcaggcaacaacggacgtgttgtaaaagaagatatcgacagctttgtaaacggaggagcgcaagaagctgcaccgcaagaaacagctgcaccacaagaaacagctgctaaaccggctgctgcaccagctccagagggcgaattcccagaaacacgcgaaaaaatgagcggtatccgtaaagcaattgcaaaagcgatggttaactctaaacacactgctcctcacgtaacgttaatggacgaagtggacgtaacaaaccttgttgcacatcgtaaacagttcaaacaggttgctgctgatcaaggaatcaagctgacttacttgccttacgttgtaaaagctcttacatctgcactgaaaaaattccctgttttaaacacgtcaattgacgataaaacagatgaagtcatccaaaaacattacttcaacatcggtatcgctgctgacactgaaaaaggcttgcttgtaccggttgtgaaaaatgcagatcgtaaatctgtctttgaaatttctgatgaaatcaatggccttgcaacaaaagctcgtgaaggcaagcttgctccagctgaaatgaaaggcgcatcttgcacaattacaaacatcggttctgccggcggacaatggttcactccggttatcaaccatccagaagttgcgattcttggtatcggacgcattgcagaaaaagcgattgttcgtgatggcgaaatcgtagcagctccagtcttagctctttctctcagcttcgaccaccgtatgatcgacggagcaactgcgcaaaatgcattaaatcacatcaagcgtttactgaacgatccacaattaattttaatggaggcgtaatgttatggtagtaggagatttccctattgaaacagatactcttgtaattggtgcgggacctggcggctatgtagctgccatccgcgctgcacagcttggacaaaaagtaacagtcgttgaaaaagcaactcttggaggcgtttgtctgaacgttggatgtatcccttcaaaagcgctgatcaatgcaggtcaccgttatgagaatgcaaaacattctgatgacatgggaatcactgctgagaatgtaacagttgatttcacaaaagttcaagaatggaaagcttctgttgtcaacaagcttactggcggtgtagcaggtcttcttaaaggcaacaaagtagatgttgtaaaaggtgaagcttactttgtagacagcaattcagttcgtgtgatggatgagaactctgctcaaacatacacgttcaaaaacgcaatcatcgctactggatctcgtcctatcgaattgccaaacttcaaatatagtgagcgtgtcctgaattcaactggcgctttggctcttaaagaaattcctaaaaagctcgttgttatcggcggcggatacatcggaactgaacttggaactgcgtatgctaacttcggtactgaacttgttattcttgaaggcggagatgaaattcttcctggcttcgaaaaacaaatgagttctcttgttacacgcagactgaagaaaaaaggcaacgttgaaatccatacaaacgcgatggctaaaggcgttgaagaaagaccagacggcgtaacagttactttcgaagtaaaaggcgaagaaaaaactgttgatgctgattacgtattgattacagtaggacgccgtccaaacactgatgagcttggtcttgagcaagtcggtatcgaaatgacggaccgcggtatcgtgaaaactgacaaacagtgccgcacaaacgtacctaacatttatgcaatcggtgatatcatcgaaggaccgccgcttgctcataaagcatcttatgaaggtaaaatcgctgcagaagctatcgctggagagcctgcagaaatcgattaccttggtattcctgcggttgttttctctgagcctgaacttgcatcagttggttacactgaagcacaggcgaaagaagaaggtcttgacattgttgctgctaaattcccatttgcagcaaacggccgcgcgctttctcttaacgaaacagacggcttcatgaagctgatcactcgtaaagaggacggtcttgtgatcggtgcacaaatcgccggagcaagtgcttctgatatgatttctgaattaagcttagcgattgaaggcggcatgactgctgaagatatcgcgatgacaattcacgctcacccaacattgggcgaaatcacaatggaagctgctgaagttgcaatcggaagtccgattcacatcgtaaaataattttcatatcaaaaacagccctcgctcaaagcggggctgtttttttattttgacagcacatgctgtaatggtttaatgatgtcttctttctttttcacacatccctcgattttaaccacgacatggcgctgatcaacaaccataagggtagggacagtttcaatctcatcttcccagccttcttttttatcatagaccttcattttatctatttgctcgggataatctttttctaaatcaagcagtgcatcgtaataaggcgcttcctggtctatttggttctcatcagaaaaaaacaggatttgtgtatgatgaatgttgtcaatccggctttttttcatcggattgatggtggaaagcgtacagcccgataaagcaaatactattatcagcatggggaataccgcgcgatatcgcatctatcttctcctctgtataaacagtagttaactagctttagtttatcacgagaggcggcttgatctgcttcttgttacctaattgttatataattgaaaccgtttttaaagtgagattacatattatatcaatcgtttaaaatagcaacctggggtatattgaattttttgctgcattcttggatgaaagttcaagaaaacgtgaaattacattatgtgctgtggcatatatatcgagtaaagcttctgtatgaagaagatattgtatgatggaaaatggaaaaacaaggtgaatatgatgagataaaataaaatgtgttatacagtttgttgttgacattttaaatgtgacatattaatataataacaacaaaagaaattaagcgttttcaaatttcaaagaaatggggaataagagatgggtacgattgtttgccaagattgcaacgaagccattcattactttgaagatgagaaagtgacaacattatacggaacatgctgcggacaatgtcaatgtcctgttgatgaagagtaaaaaaagcatgcggctttaagccgcatgctttttattttttattgaattgctttttgttctttgatgactcggatcatatgtaaagtcgagtcctcaggtccttgaacagggaggcctgcgtcaaggtttttaaaaatgtagctgatgttttcttctgtaataatttctcctggaatgaagattggaataccaggcggatataccatgacaaattcagcgataatccgtccggatgcttcttttaatgggatgacttccgtatttgcataaaaagcatcacgcggagtcattgccaataaaggtatttctggaagcagaacctcagtttgctgatgtgttacatcttgttctgacatttgctgtgcgatctcagttaaagcctctacaagccggtctgcatcattttggctgtcaccaggagtgaaaatacacaaaatattgtacagatcagaaagctcaacctcaatattaaaggattcacgaagccatttttccacgtcatgtcctgtcaggccaagacttttcacagagataatcaattttgtcggatcatagctgtaagctgctttcgacccaagaatctcagaaccgacacaataaatgccttcaatctgattgaggcgatctctcgtctgattggcaagcttgagtgtttcctcagcaagctggtggccttctgttgcaaggcgttttctggcaacatccaaagaagcgagaagcaagtaagaagttgacgtagttgtcagcatgctcaggatggattgcactctgtctttagatacaaggccttctctcatgtttaaaatagagctttgtgtcagtgatccgcccagtttgtggacacttgtcgctgctatgtccgctcctgcctgcatagccgatagcggcaattcgtcgtgaaaatgaatgtgaacgccgtgtgcttcatccacaagcactggcacatcaaacgaatgagcgagttctacgatgctttttaagtcggctgcaacaccgaaatatgtcgggttgatgacgagaagcccttttgcatccggatgttcggtaagcgcccgtttagcagattcaagtgtaatgccgtgggagatgcccaactcattgtcaatttcaggatgaataaaaattggaaccgctccggaaaatacaatagctgtcataattgatttatgaacatttcttggaataataattttatcgccaggtccgcaaacagccattaccattgtcataatggcgccgcttgttccttgaacagaaaaaaatgtgtgatccgcgccaaatgcttcagcagccagatcttgtgcttgtttaataatgccttttggcgcgtgcagatcgtctaatggttcaatattaatcaaatctatgcttaacgcgttttcaccgataaattgtctgaattctgggtccattcctgccccttttttatggccgggaatgtggaattgaacaggctgtctgcttgcatgctttttcagtcctgtgtataagggtgtttcatgttgcgacaattgttttcccacctttgtaatcatacctatgcataatagtgtgtattaaaatcagtttctcaaccgttttttagacgtaaaacaaatgaattatattatgaacttgaaagaatgtaaagaacaatttatgatcaaatgaagatgctttctcttaagggaagtaaatctacaaggagtgaagaaaatggagtatcaatatccgatgaatgaagattggacaaccgaagaagcagtggatgtgattgcatttttccagcaggttgagcttgcatatgaaaaaggggcggatcgtgaacaactgcttaaagcttaccgccgtttcaaggaaattgtaccggggaaggccgaggaaaaaaagctatgtggcgagtttgaggaacaaagtacatattctccttatcgcacggtcaaacaggcgaaagaatctgatcaggcgaagattaagatgtaggaaaaagagccggggatgtcccggctcttttttatgcttgtgatactttttgggtaagacggtacagaaaagcaagctgcttaaaggcatcgtcgatacgctgaaggaattcctggttattcatattcagcacttcttctttttggagctggatgccgcataacagctcggctttctttacagtctgcaaacgctcaaacagtgtcttcagctgttccttgtccatttcagactgtttatgtactcccggttttgtgtgatctgcagaccaaacgaagctgtcagggatatttttcgtaatggtttcttggttcacttcaagcaatttgccgtattcttctttgataggggattcataaataatcgcgaaccatacaaagacgtggctttcccataaaccaatttggaaatgcggcagttttttatagcctcttttgctgtttgcgaacgccacccagctgtcagccggggattgacggatcttcttgcgtgcttcgccacatgcggaaacatttcatctccggttaaagctgataaagttggggcaaaatgttcgcctagagctgtaagcttcggacggaccgtctcttttaatacttccatgcgcgcgtctaagccttctattgtaaatgtgttaaagtcttcttcagtgaaacgcatttgtgtcatgattttcctccttcatgctaagtatacatattttatcacagttcatacgagcttcaaaaagattgagcgcgtttgaagtaaggggaaatgtggtaataaacgagtaggtaaacacacaattttcagaatcatgttgcgcgtaaatagaacaatcatacgatataagaagtaatcattgttgaatggcaaaatgggatgcttttttacaaacaaatgatctctggaaggggcgaaagacaatgaggcaagttgtaaaagagggatttaaggaagagaaaaacaatcgtgttgctgtctggagactagaggttgattatgaattggcaaccctatatgaagcaatgcagaaagaaaatgaagagcagattgaacaaagcaaaaacaaacttgagcgacttagaaaagaatggattcgtcttaacgggtaaaaaagcgatagtgaaaacgaaccgcatgaatggttcgtttttacgtgagaagggatatttttcattttccttgctttttcattgccgttatcagtatcctataaaataaaaggtctacatagaagagaggtacgaacgaatgacaaattggacggaaattgatgagattgcaaagaaatggataagagaagcaggcgcgagaattaaacaatccatgcatgaaagcctgacaattgaaacgaaatcaaatccgaatgatttagtcaccaatattgacaaagaaaccgaaaagtttttcattgatcgaattcaagaaacatttccgggacatcggatactcggtgaagaggggcaaggagacaaaatccactcacttgagggagtcgtatggattattgatccgattgatgggacgatgaattttgtgcaccagcaaagaaattttgcgatttccattgggatttttgaaaacggtgaagggaaaatcggtttaatttatgatgtggtgcacgatgagttgtatcacgcatttagcggcagaggagcttatatgaatgaaacgaagctggctccattaaaagaaaccgtcattgaagaagcgatacttgccattaatgcaacatgggtaacggaaaacagaagaattgatcaaagtgtgttagcgccacttgtgaaaagagtcagaggcacacgctcctacggttctgccgctttagagctggcaaatgtcgcggcaggaagaatagatgcttacatcacgatgcggcttgcgccatgggactacgcagccggctgtgtgctgttaaatgaagtaggaggcacctatacgaccattgaaggagagccgtttacctttttagaaaaccacagtgtgctagccggaaacccatctatacataaaacgatatttgaagagtatcttcatgctcggaagtaggccatttgagcaggatgatctcagcttgttagaaaagctcgcggaggctcatcctgtatggaaagaggaggagtttggagataaagatgcagaagactatatcatttcctactccatgtacaacggttcatggcttgtatgggaaaaagacggtatgcctgttgccgtcagctaccatctcgagtggtctccttcaaacggtaagccgtggctcggaacggtcctgattgacccggttgaagaaaaaaagggcatgcgaagatgatcattgaacagatcagcaaattgcttagagcgaaacataaagcgatgtttgcgggagttcccattgagcgcagggaatggatactgtttttaagccaatgcggctttgaacagctgaaaacggaaaaagatgagaaaggcaaatcatttatgatcctggtgaagcctttagcagaagctgccatatgataatggcagcttatttgctgcatgcgggttcaataaaaagcctctcaaacattgagaggcttctgataatttgaaaattatttttttaccgcatgaatataatgaatcgtttcaaacgctgacaaattgtcttttcgattactaaagaaaaggtcattaatgtcgtctggtgatagatgttcatagatcagtaaaccagatgactctaacagatgttcaatctcttgataagtgaaacatgatttcatcggttccccgcttgcggcagccatcttcaccatatgttcaactcgatttgacgtcccttttgctgtaaaaagtgtttcgtccgcataatcaaaaacaatagagcttccaggcgggacatgagaaaataaattactgatcaagcttgcattttcttcccgtgttacataataagacactccgagaaggctgaagaatgtttttgtgtttttaaatccttcttctaagagaggatcatacgaaaacgttttggtgaaatccataggaacaaaatgaagatgacccggaattgtcagatttgcatccttcagcttattttttttgaattgctgtgtagccggatgatcaacctcgaaaacctgtaagctgttttctaattctggatgccgaaagcagaaagtatccagacccgctccaagaatgacatactgttttgcccccaggattaattcgttgtgcaagactttttcacaataagaagcacgtgctaggggcgtgggagacagctggatttgtgcaacccattttaatattttttcaggatcattttgaagacgttcggcgatctctttgttgaaaaacgatattccttgaatcatatttttactgatgtcgataaactctttttcgttaatgagatcttttgcgataaaatcatcaaaaataagaggtgtgtcatatcggctgtgatatgcacgggcaaaagctgaaattagagacgttaagctgggctcatttttcctcatgaaatgatcctccacaaaaaataagattcccctggccaggagaatcttattatacatacaaatatattaatagtaaattttagcataaataaatttttttgtcaatgtttttgctcttaactggacgcgcgatccttcacatagccacgtgacctgtagcagaattcgtctatcaattatgtggactgaatcattagcttttataaaatgcgcacttgtggctgcatccctcttttgcaaatcaggagcggtttctgtctcatggcagcatcttttcgtcgtttctgctgagagagaaatcaagatatgtaacaaaaaaagcctgagggatctcaggctttttctaatattacaatccaacagcattccaggctgcttcaactttagcggcatcagttgagccgtagaggtcacgggcagactgaatgagagctgccttggcatctttgaacgtggaagaaggcgtgaggtacgttgttaacgcacggtaatagatttgctgtgatttagatacaccaagttttgtgatggtgttgtaagcggctttgtttggaattccgctgtttgtgtgtacaccgccataatcgccttcatctgtgtttggaaggtttctgtaattggcgtaattgtcaggctggttgtattttgtagggttggacaggctgcgaagagcaggctggctgaccgtaatgtcttcaccgatgtcccagtcttctgtatcgttaaaatacccgaatacgtcagagaaagactcgtttaatgcacctggctgattttcataaatcaagttggctgtttcttgggtgacgccatgtgtcatttcatgcgctgtcacatctaatgagccggaaagcggagagaagaatgaaccgtcgccatcaccgtaaatcatctggtctcctgtccatgcagcgttattgtattgagtgccatagtgaacggaagaaacgattttactgcctttgttatcatagctgtttcgtttaaagtttgaataaaaataatcgtacactttaccgaggttatagtgtgcgtcaacggctgcccgctgtgatgaagatgtaaatgttttcgttgtgcttgagacaagcgttcccggaaggcggctttgtctgttttgcaagtcatatgtgatgatttgggtgccagttggttttgaaagatctcttagaacatattttccgccttcataagagatgttcaatggaacagttgcgccctttagagttgttccgcttccagtggcggcggcatgttctactttattttgctgttttaaaatgctgcctgtttcggcgtcaactaagacttcccagtttgcaggttcaggctcgacatagcgaatcgtcacgtcgtaagcaagacgatagctgccgtcttttgtttctatcgctttcaattcggctttattgctgtttttggccgctccgttagaaacagcgtctggtgatttgccgatagctttgaaagcgagtgccagcgctttttcagaagagactttttggctgttatctgtttttgcagcagattgattgtgtaattcaccattgaccgcatagacattatcggatttatcgacgtgaacgatcacttgcgaatctttaattggcactccgttaacgacaggcgcatatcgaaagtgcttgtacccaagggcatcagtcgtgctttcaacaagcttcagccttttggaaggatcacctttaaaaatgttgctgttctttttcaaaaactgcttgacagccttgtcatttggtgcagagagttctgattgcgcaatcgcatttttggagaggaaatttgtttgattctctttaagctgatgaccttcagcagcctgaacacctggcaggctgattgataaactcataaacgaagcagcgacagcaacagacaatttcttacctaaacccacaataaatccccctttttgaaaatactgaaaactttatattgttatattaaactagcattctggaatactcaacaaaaactaacataactagacaaaattgatagtattgtcctgtgtttgtttttgttgaataatatcaagatgagtcaagtgtcatgtggtggttcattcaagagttatgttttttgcatatcaaggggaagatgagatatttttgtttcatcttgaaactttttgaaaagtccgctgtctaaccgaatgaggccttaataagaagtaaaggattgttgttcgtgttggagttattcagtcattatgtattgcatttcgaacgttattttatattaagcagacaaagcaccctgctgattcaatggtcaattgttgttctggcgggcttatatcttttggtgcatcatcccaaaatgaaccggcagcgcacaatgttcttggcgggtgttatattgcggattgtgctgctggcgggagtgtctgttgaacttattcaccaggtgcaatcaacaaacttcaccagcgcttacttaagagaggacggaaaagaactgctgccgctgctgcattttttgttatacggatttgtgctgctgacggcttttcactatatgctgatgccgcgtgatcatggcggaaagggtatgttttatacgttcgacctcgccgttgtcagtttgccgatcgtacaaatgatttttagtttcttttcgtattggaaggaatacccggatgggatggagccgattgcattcgtgtttctgtttttcatcatcactcttcccattgcgttgaatgtagtgtttttcaagctgtattggagaacggataagatcttactaggcttattttatacgctgattatcggactgcttgtcttgctgcttgcgccatatcccaatcaaatctcaaaaaattatggtgcagtaatgccatatacgatttatttggcaatggcgggatttttgatgagctatcatctgttccaaaagtcaggaaaggtttatgtgcgtgtgaataagtgggtgacgatggctgttctggtgttttttgtcctgctgttaaatccgatatataacataggaacggctgctttcgctgtatcaaagccagcaaatgtccatgattcattcaattttgtcggggagcacatttcatcagaaaaagcggaacagatactaaagtcattttttcctacggatgaaacactttatttgcacgatacaaacatggatgtgcattatttctactcatttgaaagcaaaggttataaagctgaggtagatgaagtatcgcaactgattcgtaattatgaatacttacaaaaagcacatgggaaaaagctaacgaatcaggagtacaagcgaaagtccatcgctttccttgagcgacacggacgtgtgttacataaggatcatatcgaaacaaaggtatctcaagaagacggccagacagtcgtacgtatttacctgaaaaatcaacttcataaaaaagatcctgctgatgatggcacggtattttattgggaaaaggaaaccttaatggggtttagtgaagatccttcgatttatcagcttgactctcttctgcatgttcatataacagaacaagacattcatgacaaagtggaacaaatgtttacagcactgaacatctcaaaacagccttatcagatcactgatattgaaagcaatagcctgctcggaagcatggtgagagtggaaacaaaaggtggaattgttttggaatttgagggcgaatccggttgtttacatagtctttcgcttccgatgaaaaagaatatctcaatggctaacagccggctgcagcatcagatattatcgatcttcgatgctcgtggatcagaaaagaagaaaaaaagcagtcagggtgacatggtgatgtatactgattcttctaaaacatatgagttttttgaagatcaaggtcagctaaacgtttatgtatacagcgatacacctgatcagtcattcccctatacatatcgtaatggaacattggcttacgaaaaagtagcttctctatatcaggatgtcatttacaaaaagcgtatgcgcccgattatcgttcaaagaggggatgaacggcattatgcatggctgatcattattcagccgtttggttcaaatcgccatgatgcctatgtagtggatggagaaacacaagaggtgaaaagtctttatgaatcataaagaaaaagagtctgtttttgtagacctatacgacctgtataaagaaggagagctagaggatgaatcaatggaatggatgaaacagcatgaatcccaattccaaaagaatgcggaagacttaaagagtaaaacttgtttaaagagaagtcccggtgctgaagaagaaagccaaatcagatatatgaaagtatacctgtcttccatgtatatctgtttcattttattggccatttggatgacggtgtggttttacttttaatgaagcatagggattccattgaggagttgtatcgacagtattatcaagaaattttaaattatttattcagaaggactcatcatcttgaaacagccaaggacttagcgcaggacacgtttgtgaaagctcttaacggtctggcttcgtttagggggcattcttccatcagaacatggctctacaccattgcgcatcatacctttatcaattggtaccgcagggatgtcaaataccaatttactgatatcagcaaaaatgaagggttaacgcaaacaacttatgagcagcctgaacagtatctgtcacggacggtgaaaagcgaaacactgcggcaggagctcctgaagttaaaaaatcagcatcaatccgttttgattttaagagaattccaagagctttcttatgaagaaatcgctgagatattaggttggagtctttctaaggtgaaaaccacattgcaccgggctagattagagctaaagaaaaacatgacgaaaagtagagaggaggagcggatatgacctgctttctagtaagagacctgcttcctctgtatcttgaaggtgattgtaaaagagaaacggaacacgttatagaagagcatttaaaaatgtgcagcagctgcagagacatgtatgacacgatggctgagccatttgaattggaaagcgaacaggccgttgaggaggcttttctgccggaagaagaactgcgttttaaacagaggtactatggattactgattatgaaagccgcctgctggtttggagcggcggttgccgtgatgctgatcatcaaactgctgatataaaaaaaagcgcttgtccgattccggcaagcgctttttcacattaagcctggggatgaatcatatcgtaaatagcggcaagctgttcttgtgacagggcactgaagagtttttcataaacgtcagcttgcagtggcgttgcacctgcttgtagcgctgcgtctttatcatagctgtacacatcatcttgtagcacaatggctgcttgaagaatgtgaatcttgagagaaacagcggagaaaaattgttcaagtgcaagtgcttctttttctgtgaagccaagttcaactgctttttctgtatcaaatttgtaatttccatcctcgagatacacacattgtgaaacaatgctgaaaaattctgatgtcgattcccagagtgtagcaattacctgagcctcttcttttgtcattcctaactcgacagctttttcgctgtcaaaataatatacaccgtcttgttcgtatatacattgatttaatatatcaatgaatgtattgagatcttcattagtgctcgcctgatgctggagttgaacagcagtgttatcaaccagtgtttttgcgctggctgcatcaggaccgaacgttaatagagcagctgaggttattgcggcagtcgttaacatagctttttttacaaatgttttcttcatgtttcttctctcccttttgtgaattgtgctacaaattccattatagggagtagtttccggtggaggaataggcgctatggtattttatgcgtatcgttgccgaactactttttgaaggctgcacgtgtgaccgttagaacgattgtctatgtatgtaggctgttttgcatcttcctgactaagaaacaggggagataaggcttaaagaaatgaaaaacaccgctttctttgcggtgttttttgattacaatgtcgccggcggggcaatgcttttaatcaagcaagccttgttcgcgcattttcttttttaatgtaaatccgccgcccatgacagcgcaaacaagtacaatgctggcgataatgcctgcagggcttttttcagcgataaagacgccgatcagcataatgctgaaaaccgctgcaaatgcaaataatagtaaaagccaattcatttttttcataatttccatccccttttacgtcttatattaagtttacagaaaaacgtgacgcttttaaagaggatgtgtgatataatatgaaagttatctaatttttttaggagatgaaaaagtgaaacttcgaaatgatcttcgcaacatcgcgattattgcccacgttgaccatgggaaaacgactctagtcgatcagcttttacatcaggctggtacgttccgtgccaacgaacaggttgctgaacgcgcaatggactctaatgatcttgaacgcgaacgcggcattacaatattggcgaaaaatactgcgattaactataaagatacacgtatcaatattttggacacccctggacacgcagactttggggagaagtagaacggattatgaaaatggttgacggcgtagtgcttgtcgttgacgcatatgaaggctgtatgcctcaaactcgttttgttctgaaaaaagctcttgagcaaaacctgaaccctgttgttgttgtaaacaaaattgaccgtgactttgctcgtccagaggaagttatcgatgaagttctggatctgttcattgagcttgatgctaatgaagagcagctcgagttcccagtggtatatgcttccgcgattaatggaacagcgagtcttgatccgaaacaacaggatgaaaacatggaagctttatatgaaaccattattaagcatgttccggcacctgttgataatgcagaggagccgcttcaattccaagttgcccttcttgactacaacgactatgtaggccgtatcggaattggacgcgtattccgcggcacaatgaaagtcggacagcaggtttctcttatgaagcttgacggaacggcaaagtcattccgtgttacaaagatttttggtttccaaggcttaaagcgtgtggaaattgaagaagcaaaagcgggagacctcgttgcggtttccgggatggaagatatcaacgttggtgaaacggtatgtcctgtagaccatcaagatccgcttccggtgcttcgcattgatgagccgacacttcaaatgacatttgtcgtgaataacagtccgtttgcaggccgtgaaggcaaatatgtaacggcccgcaaaatcgaagagcgtcttcaatcacagcttcagacggatgtgagcttgcgtgttgagccaacagcttctcctgatgcttgggttgtttcaggacgcggtgagctgcacttgtcaattttaattgaaaatatgcgtcgtgagggctatgagcttcaagtgtcaaaacctgaagttattatcaaagaaatcgacggcgtacgctgtgagcctgttgaacgtgtgcaaattgatgttcctgaagagcatactggctctgtcatggaatcaatgggtgcccgcaaaggcgaaatggttgatatgatcaacaacggaaacggccaagtccgtctcatctttacagtcccttcccgcggattgatcggttactctacagaattcctatcattaacacgcggattcggtattttgaaccatacgtttgacagctaccagccgatgcaggcaggccaagtcggcggacgccgtcaaggtgtacttgtgtcaatggaaaacggaaaagcaacatcatacggtattcaaggaattgaagaccgcggtgtcatcttcgttgagccgggtactgaagtatacgaaggaatgatcgttggagagcataaccgtgacaacgaccttgttgttaacgtcagcaaaatgaaacagcaaacaaacgtccgttctgcaacaaaggatcagacaactacaattaaaaaagcgcgcatcatgtctcttgaggagtctctagagtacttaaacgaagatgaatattgtgaagtaacacctgaatccatccgtttaagaaagaagatcctcaataagaacgaacgtgaaaaagcagctaaaaagaaaaaaacagcaggattgtcttaatctcgtgcagaatttgaaaagatagaacccgtacgtttacaggggagggaatctttttgaatgacgtaagcgaacgcctgtcgttcttcgccgctctatatcaagtagaccggcagcctgcggcaggcatgtggctgctgtacggcacgatttttgtgttggccgttattgtatttaagcttggatttgctaaacggcttcctgtattaaaatctgcagtggtgtatgtatttttggctttgggctgcactgttttgacttttttaggggtgtttttgcccgtggcagaaggattggtcgtcgctgcgctgattttaatcatttacaaaatccggctgtatcagtcgaaaaaaggacagtctgcaaaatcataaaagactcagctgaaagctgagtcttttttgtgttctgtatggttaagcggccgctttattttttgactttttcttttttctgctgtcccgggtgaaaagtaaattttcccgttttcagccgttcctctgtttttttggcaatccgatcgtggcattcctggcacatatatgtatggatcgggcggtttcgaagccgtttcgcgatcagggtatcatcatcaattgtttcaattttatcgcaaatagaacatttgaccctcatcatatcacctctttcactaacatgtattataccacggatcagaagctgtccaaaataagaaaaagctaaagcgcaaggctatagcttagtcattgttgttctttttcatatgatgatcagattgatcgttttgctccttctccatttcctgttgatgttttctatttaattggtcattttgctgctttgtttgcggttcgtcttcattgtcaatcacatcgttaggcacttcgggaagcactcggccgacaattgcagctaattcatccagtatacctgttaccggatggccctcgctgatttctctgctcatttcgcgaaggcggctgaccgtatcgggatcagcaatgactactgcgttggcgccatatcgatcattctttagcgcctgagctacagaatatttaatggtttccactttgcttctgtccaaagtatcatcgacatcaatcccaacaacagcatagcctcccagcacaacggctgttgcatccttgacgtcggggtttttttcagcaacgctgacaagatgcttggcaatatccgttcttgttccattgtcttttgtttcttgagttgtgtcctttacgtgaatcggtttagtctcctgctgtcttgttgattctttttcaacattctggccctgttttccttgttgataggcacaagcggacaggataagtgtcagctgtatgataatgaaaagaattcgcacttgcgggttccctccttgaaatgctttcattaattttattgttgaattaaccttctatctttatgcacaaaaacatatattttagcaggcattcacctttttcatcaaaagagaagcaggaagaactttgacccttatatcaggaggctgagacttgagtaaaatttatgtgttagatacgaatgtgttattacaggatcctaacgcgatattttcttttgaagaaaatgaggttgtcatccctgctgtcgttttagaagaggttgattcaaaaaaacggtatatggacgaagttgggaggaatgcaaggcacgtatctaagctaatcgatgcgctaagacaaaagggcaggctgcatgagcatgtaccgcttgacaccggcggcacactgagaattgaactgaatcatcgttcgtttcaccagctgcaagagatctttattgaaaagacgaacgataatcgcatattagccgttgcgaaaaacttaagcctcgaggaagaaaccaaggaaaatggcaggccggttatcctcgtcagtaaggatgtactggtcagggttaaagccgacgcaatcggactgcttgctgaagatttcttgaatgaccgggttgtggacaatgatgaaatgtacagcggctataaagatttatatatcagccagcagctgttcagctctttttacgggaaaaatcaaatttcagtaaacgatgtgaaacagcatgcgttttatccgaatcagtttgctttaatgaaggatgagctaggaggatcctcctcggcaatcggaattgcagataaaaccggaacggtattaaaaagactcgtatttgatgatgaacatatatggggaatcaggccgaaaaatgtacagcagacaatggcattagagcttttgctgcgggaagatattccgcttgtcaccctgatcggcaaagcgggaaccggcaaaacgctcttagctttggcggcagggctattacagacagaagacttgggaatatataaaaagctggttgtcgcaaggccgattgttcctgttggcaaggacatcgggtatttgccaggcgaaaaagaggaaaagctaaagccttggatgcagccgatttttgacaacttagagtttctgtttaatgcgaaaaaaccaggggagcttgatgctattttggcgggaattggctcaattcaggtagaggcgctgacttatatcagagggagaagcattccagatcaatttattatcattgatgaagcgcaaaatttgaccaggcatgaggtgaaaactttgctgacgagagtcggtgagggcagtaaaattgtcttaatgggtgaccctgaacaaattgatcacccatatttagacagtctgaacaatggtttagcctatgtggttgagcggtttaaaggacaacccatctcaggcagcgtgaagctgttaaaaggtgagagatcaggtctcgcccagctcgcagctgatttgctgtaacattaaataatttcgatctcttttacgtcggtaatcggctgtttgtgatgaatcgggtcttcaaagtaaatatgcacggggccgccttcttgaatcggcttgcctgcctcactgaaatggacaatactgttcagagcggtttccagagaaacggcggcctttcccgaacttgtgacaaatacacattgtgtcgcagagctgttcggctcagcatttttcaggacagtcccaagtctcattgcgaaactgccgttcatcagtttttgcttctcatattgtttttccgtctttaatgtaggcggcgcaattcgcccctctctgatgacgcgttccggatcaaggtcggattcatccccggctgattgtaaatatgtgtcttgactgtcccctttgcggtcaaacgaaaatttgcgatcatcaaaaatccatacgcttggatcaatggtaattggatatgtaacattgccttttacttggataacgctcatgatatgacccccttctctcaaaattataaaagttttcgcatgaattgtcactttgtgtacaaattatgtgtattgaaatgctgagggaacgagggtgtttgcatggtatgccggcataatgatgagcttgaagccttagtgaaaaaggcgaaaaaagtaacggacaagggggaggtagccagctatattcccgccttggcaaaagctgataaacacgacctgtcagtggcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaattcaattatcaagctcgaaacagtgaatccgagcaagccgttaaaccctatgattaatgccggggcattggtagtgacaagtctgataagaggaagaacggtgaaagagagacttgattatttgctttcttttatcagaaggctgacaaacaaccaagagattacatactgccgggaagtggctgaatctgaatacagcacttcaatgattaatcgggcgatgtgttattatatgaagcagtacggcatttttgaagatgatgtagaagcagtaatggatttatatacgaagcaatgcgcgattgagatgaacagcttggatttagcgaaaatcggatctgtatttgcattgaacggcagacatccagagactggggagcaagtcatctcaaaagatgtcgctagaatttgcaaaacgtttatggtgacgtgcggaatgtacaatgcaagcggggaattcgcaattaaggtcggaattcctgcgaaaagcggcgtatccggcgggattatgggcatttcgccttacgatttcgggatcggcatattcggccccgcattagacgaaaaagggaacagcattgcaggtgtaaagcttttggaaataatgtctgagatgtacaggctgagtattttttaatttatgtcatatgcttaaatcctcttgcattttctgttgataccctttatgataaatagaagaattaggtactcgcctggggaacggagggatacttttggcttcagagatgatagttgaccatcggcaaaaagcttttgaactcttaaaagtggacgctgagaagattttgaagctgatccgagtacaaatggataacttaacgatgcctcaatgtcctctatatgaagaggttttagatactcaaatgttcgggctttcgagggaaatcgattttgctgtccgcctgggattggttgatgaaaaagacggtaaagaccttttatacacattggaacgcgaattgtctgctttacatgacgcgtttacagctaaataaatgataaaactcaaacttattaacagtttgggtttttttataaccgctatttttctctcatctcataaaagacggtctttttttacacattccttccgaatcgtatagagattcttcgtctcgtttgataaattgtagtaaaataaaaaagataaatacataaaaaccatagataatggaagttagaagcagggaagaggatgttatgttaaaaaaaatgctaaaatcttatgattactcactgatattcgcaatcgttttattatgcggattcggtttagtgatggtatacagctcaagcatgattacggctgtctcccggtatggagtaagcagtaattttttcttcatgcggcagctgtttgctttaattgcgggtggcgctctatttattctcatggcgttgtttccttataaagcactggcccatcaaaggtttcagaaggggatactgcttgtatctgttcttgcgcttatctcactgtttgtattcgggcatgttgccggaaacgcgcaaagctggtttaaaatcggcggaatgagtattcagccggggagtttgtgaaactggtcgtgattttatacctcgcagccgtatatgcaaaaaaacaaagctatattgaccatctattaacgggtgtagctcctcccgtagtcatgacgcttgtgatttgcgggttaattgccatgcagcctgatttcggtacagccatgattatagggctgattgcgacgtgcatgatcttgtgctccggcttcagcggaaagacgctggtgaggctgcttttgctcggcggaattgttttcattttagtcagcccgattctctatttaaatcaggatcaaattttaactaaaggccgtttggcgcgttttgagagtcttgaagacccatttaagtatgcaaattcatcaggtttgcaagtgatcaattcttattatgcgatcagctcaggcggcattttcggcctggggctcggtgaaagtatccaaaaatacggatatctgcctgaatcacacactgactttattatggctgtcattgctgaagagctcggcatttttggggttttgtttgtgattttcctattgggttttgtcgtcattaaaggtttttatatagccagaaagtgcgaggacccgtttggaagtcttctggcgatcggcatttcaagtatgattgccatccagtcgtttattaaccttggcggtgtcagcggattaattccgattacaggggttacgctgccatttatcagttacgggggctcttctttggtgctgctgctggggagtatggggatattagcgaatatcagcatgtttgtgaaatattcagagaataagaaaaagaaagagcccttggcgccgaagggaatgaaaaagaaacagctcaaaaaaactgtttatcagtaaaaaacaagtgtgtacaggggaaggatattccgctatgatagattatattccattcgggtaagggggagaaaagtttgtctcagcaatcgatacaaaaagtattagtagcaaacaggggagaaattgcaatccgaatattccgggcgtgtaccgagttgaatattcgtacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcatagggccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgcggtatgcggattgtcagatctgaaagtgaagtcaaagaagcatatgagcgtgctaaatcagaggcgaaagcagcctttggcaatgatgaagtttatgtagaaaaattaattgagaatccaaaacatattgaggttcaggtcattggagacaagcagggcaatgtcgtccatctttttgagagggattgttccgttcaaagacgccatcaaaaggtcattgaagtggcgccgagtgtctcgctgtcacctgaattaagggaccaaatttgtgaggcggcagttgcgcttgccaaaaatgtaaactatataaatgcggggacggtcgaattccttgttgcaaacaacgagttttactttattgaagtaaaccctcgcgtacaagttgaacacacgataacagaaatgattactggtgtcgatattgttcagactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggtgccgtgatcacaccatactatgattcacttctcgttaagctttcaacttgggctttaacgtttgaacaggcagctgccaaaatggtgcgaaaccttcaggagttcagaatcagaggcataaaaacgaacattccgttccttgagaacgttgcaaaacatgagaagttcctgacagggcaatatgatacgtctttcattgatacaacgcctgaattatttaatttccctaaacaaaaagaccgcggaacgaaaatgctcacttacatcggcaatgtgacagtaaacggcttccccggaatcgggaaaaaagaaaaaccggcgtttgacaaaccgttaagcgtaaaggtagacgttgatcagcagcctgccaaaggaacaaagcaaattctcgatgaaaaaggtgcagaagggcttgcaaattgggttaaggagcagaaatctgtccttttaactgatacgacattcagggatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaagcgtttggaagatcttcgcaaagaagtgccgaataccttattccagatgctgcttcgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgccgttcgggataccggcaaagtggcagaagctgcgatttgttatacgggagatatccttgacaagaaccggacgaagtacgatcttgcttattatacatcgatggcgaaggagcttgaggcggccggagcccatattctcgggattaaagatatggcagggctgttaaaaccgcaggctgcatatgaacttgtttctgcgttgaaagaaacgatcgacattccggttcaccttcatacgcatgatacgagcggaaacggtatttatatgtatgcgaaagctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgagcacgaaatgccagggggcaatacagcaacctgcagcagcaagccaagggagtaggccttggcgaccgctggaacgaagtcaaggaaatgtacagacgcgtgaacgatatgttcggtgacatcgtcaaggtaacgccttcctcaaaagtagtcggagatatggcactctacatggtgcaaaacaatctgactgaaaaagacgtttacgaaaaaggcgaatctttagatttccctgattctgtcgtggagcttttcaaaggaaatatcggccagcctcatggcggattcccggaaaaactgcaaaagctgatcttaaaagggcaggagccgattacagtcagaccgggcgaactgcttgagccggtgtcatttgaagcgatcaaacaggaatttaaagagcagcataacttggaaatttcagatcaggatgctgtggcgtatgccctttatcctaaagtcttcactgattatgtgaaaacgacagaaagctacggagacatttcggtattagatacaccgacattcttctacggtatgacattaggtgaagagatagaagttgaaattgagcgcggcaaaacgctgatcgttaagctgatttcaatcggtgagcctcagcctgacgccactcgcgtcgtttatttcgaactgaacgggcagccgcgtgaagtagtcattaaagatgaaagcattaagtcttccgttcaggaaaggctgaaagcagaccggacaaatccaagccacatcgcagcttccatgcctggaaccgttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggcgagccgatccaaacgggagatctgcttctcgaaattgaaaaagcataaaaaaaacaagagtgtatatcaatgatatacactcttgttttttatatagaaaatgtggagtgaaacagatggttagaagagatataaggggacttcagagattatagagtactgtcacaagcccaaaataaaaagaggcttatataccaccaattttttagatgctttgtagtagtccatgcatatttctttaagcactatctgattttccaatggccaaaaggctttaatacttatgttcgcggactacatatgaaatttctataatacgatgagaaagggacagactgaagtgagccgctcactgatcatcaagttcagcgaaggctggccattgaaacaataaagcgccaaaacaagacatgaaaaaagaccaaagccgcctaaggctttggtcttgagtccttatgattgcctggattcataacggaaacgagcaatcaataataagaagtagcatagaacgccaaacagacaggcaataaagaacgagtgggcaagtgcaaagcccagagccagttcagagtatacgatcataataccggacagtgcctgtaatgtaatgaaaataagacatgagatccatccccaaaagatctgtttttgatctttataggaagtaatagcatgaacagcggcaacaataatccatacaaataacagtaaggctgctgctctgtggcccatttgcacccattcatggaattgggtcggaagtccattgttcagcgggctgcacagcggcacatcaggacatgccagacttgattcagtgtgtcttacatatgcgcctgtatacacaacgatataggaatatatcaaaattcctatcatgtgaaattgcatctttttgccgatttgaagcggcttaaccagtgttctgactgatttatcagcttcaaatatgagcaatgttaaaataagcactgaagcaaaagaaattaatgagatgccgaagtgaagtgccataatcagcgcgttcgaaccgaatacgacagccaatgcgccaagcaatgcctgaagaaataaaaagataattgacatgatcgcgagaaacgttgtttcacgaaaaatcggcgtgatttttctccatgaccaaaacgcaaggcttagcacaaggataatagagattccgcttgcgaatcggtggctccattcaataattgaagccggattcagttcagggaaaaaacggccgtgacacagcggccactgtctgccgcatccttggccggaacctgtttttgtaacgagggcacccccgattaaaacaattagcatgacaaatgtcgtcagaacaccgagagcttttaatgctttattcatacaatattcaccttcttaacatactgctgcaattttatatacgttccaagtgtaagcgaatatgtgttttgtggcaattcccagagccttttgttcacaaaaatataatagaatgacggcttctggaaaatgtacacttgattattcatgccgggtctgatagaaataaggtaaacgcaatgccgatttggagattgccttcatctttggtaaaattcataaaaagttcacaaataaattcctgtttgtcgtttaatatttaataggatgtttttttacaagatgttatcttgtatgatagagttgcaggttattttattctcctgcgttaggtttgtaagggaggtttacgttatggctaactccagaatcttaaatgatacagctatagacggacaaattgaagaaacaacggcatggaaagattttctgtcccttattaaaatagggatcgtcaattctaacctcatcacgactttcactggaatgtggcttgcactgcatatatccggtttaagttttttaggcaatataaacaccgttcttcttacgttaatcgggtcttcactgattattgcgggctcctgcgcgatcaataactggtatgaccgggacattgatcatcttatggagcgtacgaaagtaagaccgacggttacgggtaaaattcagccgagtcaggcgttatggtctggaattttgctggttgctttaggattgatcatgctgctgatgacaactgtcatggctgctgttatcggttttatcggagtctttacgtatgttgtattgtacacaatgtggacgaaacgccgctatacgattaacacagtagtaggaagcgtttccggtgcagtgccgccgcttattggatggacggcagtggaagggaatatcggtgtcgtagcatgggtgttattcatgattttatttatttggcagattcctcacttcttagcattggctattaagaaaactgaggattacagagctgcaaatattccgatgcttcctgtcgtatacggatttgaagtgacaaaaagacaaattattgtgtgggttgcgtgcctgatgccgcttccgtttttccttggtagtctgggtcttccgattgtcattctcggcttgctgttaaatatcggctggctgattcttggcttaatgggattccgctccaagaatatcatgaagtgggcaacgcagatgttcgtttactcgcttaactacatgacaatctatttcgttgccatggttgtcttgacgcttttctaaaaaatagatatgatgcttgttttatcgcttcaaaataaacgatgacaactagtaaatgccgccttgacctcttgtttaatcaggcggctttacttttatacatagatggcattttgagtaaaaaaactcataatttaagagaagaggaaatgtaagtgctttattggtgataggttggatggcgatagatttcgatccgctttccgcctttgtattgaccagaaaaggggttgggtgaaatggtaaagcattggcgtcttattttattattagccttagtgccgcttctattaagcggatgtggaaaaccttttttatccacgctcaagcctgctggcgaggtggctgataaacagtatgacctgacagtgctcagcacattgattatggtggttgttgttgcagtagtatctgttatcttcttttatgtgattgtgagattcagaagatcacgggtcggtgagaacacgataccgaaacaggtagaggggaataaatttttagaaatcacatggaccgtgatcccgattttgctgctcattattcttgtgattcctgttgtattatatacgctggagctagcggacacatcaccaatggataaaaaaggccgcaaagctgaggatgctcttgtagtcaatgttagggcaaatttatactggtgggagtttgagtaccctgattacggcattatcacaagccaggagctgattgtaccgacagatcagcgtgtatattttaatttaaaagcctctgatgtaaaacattccttctggattccttcagttggaggaaaacttgatacgaatacggataatgaaaataagttcttcctgacatttgattcaaaacgaagcaaagaggcaggagatatgttttttgggaagtgtgcagagctttgcggcccttcacatgcgctgatggattttaaggtgaagacgatgtctgcaaaagaatttcagggctggacaaaagaaatgaagaactataagtctacagcagagagcgatttggctaagcagggtgaagaactgtttaaagagaaaaactgcctgagctgccatgcggtagagccgaatgataagcgtgcagaagccgctagaacggcacctaacttggcgaccttcggtgaaaggacaaaagtggcaggggtgaaagaggccaacaaagaaaatgtgaaggcttggctgaaggaccctgacagcataaagccggggaacaaaatgacaggcacatatccaaagctctcagacagcgaaacagatgcgctttatgaatacttaaaaggcttaaaagcggaaagcaagtagggaagaaagggagatattggggaggtcacatatgttgaatgcgcttacagaaaagcggacgcgcggatctatgctttgggattatttgacgacggtggaccataaaaaaatcgcgattctttatttagtggcagggggattcttctttcttgtcgggggaattgaagcgatgtttatcagaattcagcttgcaaagccggaaaatgcgtttctcagtgctcaagcgtacaatgaagtaatgactatgcacggaacgacgatgatctttcttgctgcgatgccgctcttatttgccttgatgaatgcggttgtgcctttgcagatcggggctcgggacgtttcgtttccatttttaaacgcgcttggtttttggctcttctttttcgggggcattttcttaaatctaagctggtttttgggcggagcgccagatgcgggctggacgtcatatgcctcactttcgcttcattctaaagggcacggcatagactttttcgtcctcggactccaaatatcggggctcgggacgctgatagccgggattaactttttggccacgattatcaacatgagggctccgggcatgacgtatatgaggctgcctttgtttacatggacgacatttgtggcctcggcattgattttgtttgcgtttccgccgcttacggtcggattggctctcatgatgctggatcggctgttcggaaccaatttctttaatccggagcttggcggaaatacggtcatttgggaacatttattttggatcttcggccacccggaggtttatatcctaattttgcctgcattcggtattttttctgaggtcatccctgtgttcgccagaaagcgtttgtttggctattcttcaatggtttttgcaatcgtgctcattggctttctgggctttatggtttgggtgcaccacatgttcacgactggtctcggctcgattgcaaatgcgatttttgcggttgcaacaatggctatcgcgattccgaccgggattaagatttttaactggctgttgacgatttggggaggaaatgtgaagtatacaaccgctatgctgtatgctgtctcatttattccatcctttgtgctcggcggtgtgacgggagtcatgctggcagctgctgcggctgattatcagtttcatgatacgtattttgtggttgcgcacttccactacgtcattattggcggcgttgtattcggccttttagccggtgttcatttctggtggccgaaaatgttcggtaaaattctgcatgaaacgatggggaaaatttcatttgtattgttttttatcggctttcacctcacgtttttcattcagcattttgtcggcttaatggggatgccgcgccgggtttatacgtttttgccaggacagggtctggaaaccggcaacttgatcagtacaatcggggcgttttttatggcggcagctgttattcttctgctggtcaatgtcatatggacatcggtaaaaggtgaatatgtaggtgctgatccatggcatgacggacgtacgctggaatggaccgtttcttcaccgccgccggagtataactttaaacagcttccttttgtcagaggacttgatccgctttggatcgagaagcaggcagggcacaaatcaatgacgccggcggaaccggttgatgatattcatatgccaaacggctcaatcctgccgctcatcatttccttcggcctttttgtcgcagcgttcgggctgctgtacagaagtgattacgcttggggtctgccggtgatctttatcgggctcggcatcacatttattacgatgctgcttcgttcagtaattgatgatcacggctatcatattcataaagaggaactgccgaacgatgataaaggggtgaaggcataatgcaagttcaagaaaaattcaccgcagaaacctttccagcttctcctgaaaaagtaaccctggaagggaaaaataaatttttaggcttttggctttttcttggcggagagactgttctgtttgcgtctctcttcgccacgtttcttgcgcttcggaattcaaatgccggtgatccgcctacgacggaaatgttcgatgtgacacttgtattcattgccacaatgcttctattaacgagcagtttaacgagtgtgtacgcgatgtaccacatgaagaacttttccttcggaaagatgcagctttggctgggaattacgattttattgggggcgggctttttaggactggaaatctatgagttcaagcattacacccatgaatttggctttactatcacaagctctgcccttggttctgcgttttacacgcttgtcggtacacacggcgcccacgtggcatttgggcttatgtggatcagcacgcttatgatccgcaatgccaagagagggctgaatctgtatacggcgcctaagttttacgttgccagcctttattggcactttattgatgtcgtgtgggtcttcatctttaccgttgtatatttaatggggatggtgggataaacatggtcgataaaaaaagcagagggcatatcaatagcgaccttgaatttaagaaaaaaaagcatgcccgggagatgaaatatcaagttctgtcttttggtttaatgatcggtcttacgattgttgcatttctgactgtggccacggacggtgtcggcagctggtttacgattcctttcattattttgctagctgcaattcaagtcatctttcagctgtattatttcatgcatatgaatcagaaagggcatgaggcgccggcactgtttttgtattcaggggtgtttgtcgcgtttatcactgtgcttgcgtttgtgacaattatatggtggtaatttgaacagccgccggaggtgaagaaatgaatcagttggagatatttgggtttcgcgcgatgtggagcccttatcttttttgtatcctgttaggcattacggcgctttatctctatttttacaggcgaatgtcttcaaagccgaatcgaataactggtaaagagatggtgtgctttctgtcggcgatgctgtttttatatgcagccgagggaagcccggttgatctgctcggacatattatgttcagtgcgcatatggtgcagatggccgtcctgtatttggttgtcccgccgcttttgatcgcgggaattcctgcatggctctgggaaaaaatcattttcaggccttcaatcaaaccggttttttccttttttacgacgcctttaattgctttgcttttgtttaacggcattttttctttatatcatgtaccgcttatatttgatactgtcaaaaccgatccgttttaccatacattaatcacttggcttatctttgtgcttgcgttcttcatgtggtggccgcttgttcataaggttgagcgtctacggcagctcagcggcttgatgaagctgggttatattatggcggacggtatgctgctcacacctgcttgcgccttgatcatgttcagcggtgcaccgttatacgctacctatacagatccggctgtatgggctgaggcaatgaggctttgcgtgccagcggatatgatggggcaggtcccattaacagggccagagatgttgaatacactgcctttgttagaggatcagcagctcggagcagtcatgatgaaaatcattcaggaaattgtgtacggtacttttttggccattatttttttccaatgggtgaagaaagaaagggaaaaggatgggcaggaggagccgccgtatattcagcagacgatatcataaaaggtacagcgaaatatgctgtaccttttcgttacatttgaactgtttttaacatgttggctatgtcctgaatcagtgccttgctttttgtcacaacctgtacgggaaactcttccgtttctccatattctactccatgagggtagtaatgctttcctaggagaggggacattaattgaatcacggcgcgcccgcttccgacatcgccttctgccgcaataccttgtatccgcaggtaaaacgtaccctcaatcgtcgaaaacttcttgtcataggtgactctctcgtaatcccattgacccgctctgataagacctttgctttccattaagtcgtctagccagctgagctcagccttaaccccttcaagtccgctttcagtaaacttcaacactgacccctccttataaaaattacctttcctgacaatcatagtatgaaagcgttaaactttcaatgaatcttcttcttttgaaagtatgcaaaaattaaattttgacgacaatagcactagactaaaggaggttaaacggatgacaaaaataaaagatctgatgacagccgacttgcaatattgcacggtattagataatgtatatgaagctgcagtaaagatgaaggacgcaaatgtaggagcgattccggtagttgatgaggacggggaaacattggtcggcatcgtaaccgaccgcgatctcgtattaagaggaatcgccatcaaaaaaccgaactcgcaaaaaatcactgacgcgatgactgaaaaacctgtcagtgtggaggaagatgcttcagtcgatgaggttcttcatttgatggcatcgcatcagctcagaaggataccagttacaaaaaataaaaaactgactggaattgtcacgcttggtgatctttctttatctgagcaaacgaatgaacgtgccggcagcgccttatcggatatttccgaaggcgataatagagaagaaggcttttttcattaacacataaatctttgacatgttaaataggctgtattgtaatgggatgtaaacaagagattgtgaatcgccacgggggtgatagattgaaaaatatattgagagcaatggttatcctcttgattatttgcggaacttatgttctgtttattcaatatggatctgttcctgaaaagaaatcaaatgacagcgagcctcaggtgtcaaatgaggaagcgcaaagcggcaaacgaatacatatgccgacctcaggattattgtccttcatgggcaagtccgccgatgaagtaacgaaaaagcttggggaacctgaacgcattgacccttcagcttatgattacgattggtgggtatacaatcaaggtaaggaccaatatatccagatcggggtattaaacaataaagtggtcacattattcgctgctgggaatgatattaacgccaagcctttcaaaattggagaatcaactggcgaagtattcaagaccacccaggtggcaccatttgtgaatgtagagtataaaggaaattcctatcggtttgaattttctgaagaagatatcaatacaagaccgactgtaaaggtaggaaagatgtatgtccagctgtatatggacaaatttgaggggaagctatccagcatcagggcgtttgatgcgcaaacctttgtaaagcaaagaccttatgaggtagtgtaccgcggggaattaattaaaccgaaagccgtttcagatgagaaatggaaaaagatccaaacaacgagcgaaaagcaaatccttgatttgacgaatgtcatacgctttaaacatggacttgcgaagcttgagtgggatcagccaacggcggaggtggcatttggacatagtgaggatatgaaggaaaataattatttctcccatgtctctaaaaaatacggctcgctgaaagaccgcttagaagaagggcatgttgactttcagcaagcgggagaaaatatcgcatacaattatgtggacggtccggctgctgtagaaggctggctgaatagcgaaggccatcgaaaagcgcttctgaattcagattatacgcatcttggtgtcggagtagaccggaaatattacacccaaaattttattaagcgatggtaatgaaagccgcggacgaatggtcccggctttttctatttccatacaaactggtctgaatgaatgtgctgatagcttacagataaggccgtttctcattccttcagtcaggctttttcaccagtgtatagggatatcggttaaaattcatttgggaatgaatataggcgaacacaatgcccgacaaaacgatacattgtagtaggtaacgattttcggagggggtgaggattgtggcgaatcaacatgccaatcattcaatcaatgactttaaacaattcgtcaaaaagcatcccaagctgataaaagaagtgcgcaaagaacaaagaagctggcaggacgtatatgaaaattgggtcctcttcggggagagcgacccgatttgggatccgtatcgggaaccggaagcagctgctgaagctgtgcctgaaacaccgcaaaaaaatgattttatctcgaaaatggtgacagcggtgaaaaagatggatgtcaatcaaatgaacgaacaaatcaataaaatgagccagtcgatctcatcgttgcaaagccttcttaatacattttccggaagcggacagaagcattctcagccaggttctggacagcatcctttttcttttcgaaaggattaaaaaaggggagctcatatgcgcaaagaggttcaggaatatattttagcaaacgaagaacggaaacgattcatcagagaacagccgatatggtaccgcaggctttcaagaaaaccggatgatctgtcctcctttcagcttgaaatgatgaatttttatgaaaaaaccattccgcatcgggtgaatcagtttacgaacgggattcaaatggcgcaaatgatgatgcaaatgtttcaagcgatgcggacaaaagattaaaagaccctgaaaaagggtcttttttcatgcggtcataaggttttgttggcggctgcggttaagcattttccaattggctggtttcatggtaaactaacaactggaggtgcatgttatgtatgcgacgatggaatccgtgcggcttcaaagtgaagctcagcagcttgccgagatgattctgcagtcggagacggctgagaactaccgcaattgttacaagcgtctccaggaagatgaagaggcaggtcggattattcgttcttttatcaaaataaaagagcagtatgaggatgtacagcgttttggcaaatatcatcctgactatagagaaatatcccggaaaatgagggagatcaaacgtgagctggacctgaacgacaaggtggctgacttcaagagagctgaaaatgagctccagtccattcttgatgaggtcagcgttgagattgggacagctgtttcggagcatgtgaaagttccgactgggaacccttattttgacggtttgtcttcatgcggaggcggctgcggttcaggcggaagctgcggatgtaaagtgtcctgacgagactggccgtctcgtcttttacatataagagaaaacaggcaggtgattgtattggagaataggcgccagggcatggttgtgtatctgcactccctaaagcagagcaaaatgctgaggaagttcgggaatgtgcactatgtatcaaaacgattaaaatatgtcgtactgtactgtgatatgaaccaaattgaaaaaacaatggacaagattgcatcttactcatttgtgaaaaaagtggagccttcttataaaccgtttttaaaattggaattcgagtcaaagcttgataaggcaaaagaatacgattataaaatcggcatatagctataaaaaaatccccgcaggcatctgcggggtccttctattccttaatatgttaaggagaaggcaaagggagaggagaaaccggaggaagaacttatggggaaacgtaagtcttctccgcggttggcaacaacatcctctagatgctgttgcttatagtatggacaaggatgattctgcttatacacctgtttatcaagattagcgttcattgtttggaagaatgctttatgttaagataggattgatttttttctatgtacatagcggcgtccggccgaataaagaaacaaaatagcttttagaaaaagtggtgtggaacatgagagtaatttctggatcaaaaaaaggccgttcactaaaggctgtacccggaacatcaacaagaccgacaaccgacaaagtgaaggaatccattttcaatatgattggcccttattttgacgggggcaggggacttgacttattcgcagggagcggaggacttggaatcgaagcgctttcacgcgggtttgagcattgtatattcgttgaccgtgattttaaagcgattcaaacggtaaaatctaatttgaaaacgctggagcttacaaaacatgcgcaggtataccgcaatgatgcggaacgtgctttgcacgctgctgctaaaagagaaaccggctttcgcggcatttttctcgatccgccgtataaggaacaaaagctgaaagcacttttaacgatgattgacgaatatcaaatgctggaagaagacggctttatcgtcgctgagcatgacagagaggtcgagcttcccgaaaccgtaggagatcttgtgatgacaagaaaagaaacctatgggttaacaggtgtgtcgatttataaaaagagggggtagtgaggtggcgagtatagctgtctgtcccggcagttttgatccggtgacctacgggcatctggacatcatcaaacgcggggcgcatatttttgaacaagtgtatgtatgtgtgctgaataattcttcaaaaaagcctttgttcagtgtggaagaacggtgtgagcttctgagagaagtgacaaaagacattccgaacataacagttgaaacatcgcaaggcctgttaatcgattatgcaaaaagaaaaaatgcgaaagcgattttaagaggcttgagagctgtatctgattttgaatacgagatgcaggggacatcagtaaaccgtgtgcttgatgaatctattgagacattttttatgatgacaaacaatcaatattcgtttctaagttcaagcatcgtaaaagaagtggcaagatacaacggctcggtatcagagtttgtaccgccggaagtagagctggcgcttcagcaaaaattcagacaaggatgagggttttgactcatcctttttttgttccgtttgtcagtctgtaagaaaaaatgataatgtacgtaaacagcgcgcatagtgtgacagcaggtccgatctgcacaagcagattccagccgtttataaaggcagttggcatgtcactgctgttaagagatttaaatacatactgatacggatcatgccatgccgtgtaaagaggtttccataaaagcatgacgaagacagcggcataaacgccctgcagcaaacgtgcgataaagaatggtttaaatctaatgtcggtttccgataaaatacctgccacctgagcttgtacggaaaagccgctaaacccgagaataaagctgacgataatggctttttgcagaagagaaacatctgtctcgctgacaagcttgctgcctaatgtaatttcaaacatccctgataaaagcggaatgtccaattgagtcggaagctgaaacaaagtcagtgctccttttgtgaaaacagacaaaacatcagtcaactggaccactgacaacagccgattgaagacagaaaataaaataataaagccgcctaccataagaagcgtttgaacagaagacgtcacggcgtcgcctaaaattttacccaagggccgtttttctgcaagtctggcggtatgaagagcgtgtaaagcatctttgactgaagggaaaggtatcgttttctttcttctgagatgctgctcttccttgcggccataggaacgcattgttaaaccgacggcaagattccccaaatagtgtgcagaagctaataaaatgcctagtgatgcgttttgaaagaaaccgacggcaacagcgccgaaaataaagagcgggtttgaagaattggtaaacgacgcgagccgttctgcttctactcttgaaatctgattttcctgccgcagacgggcagtgagttttgcgcccgctgggtttcctgatgccattcccatagcaagaacgaagccgccgacacccggcacgcgaaagatcggccgcataaaaggctcaagcaaaacaccgacaaaccgcacaatgccaaagccgattaagagttcggacagaataaaaaatggcagcaatgacggaaacacaacctcccaccacatagacagcccggttttagaggcttcgaatgaggcctgtggatgtgagatgacagtcgctgttaaaaaaagaaaaaacgaggcaatcaaaagtgtattaatcttcgacaagttcattcttacctccccgatgctaaaaatgcccaatgacatgtatatcatgataaaataatgtatgatgtaaaacggccaagcagtacctgtcctcttgattctttgtactaatatacgagcataggggttcagtttagaccatagaattcggtatacagggaattcaggcaggaggttaacgctttggccaaacctaaaatcgggttagcgttaggatcgggaggggccagagggcttgctcatctcggtgtgctttccagtttacataagcaccaaattgaagtggatatgattgcaggaagcagcatgggcgctttggtgggcagtttttacgccgccggacatgacgtggcaacgatgaaaaaagtagccaaagcctttaaacgaaggctttatgctgattatacggtgccgaagctcggttttttaaaaggtgaccgcgtcagacagcttgtgcatgcttatacattcggaaaaccgattgaagagctccaaatcccgctgggcattgttgcgtgtgatctacagacgggagaaaagattgtgttccgaaaaggatcagtgtcagatgcagtgagggccagcatcagcatcccgggtatctttattccgcagcggctggacggacgccttcttgtagacggcgcggtcgtcgatcgaattccggtttctgttgtgaaagacatgggagctgatattatcatcgcttcggatgtttccagggttcgaaaaactgaaacagcagtgcatatttttgatgtgattatgcaaagtatggatatactgcaaaatgaattagtgcggcatcaaacaattgccgcagatatcatgattcgcccttcccttgaaacatacagctcaagctcgtttgccaatattgaagaaatgatatcggcaggcgaagaggcgacaaaccgaatgatcagcaagataagaaaagaaatagagaattgggagggctcataatttgctacgtaaaaaacattttagctggatgctcgtcatcctcatactgatcgccgttttatcatttataaaacttccatactatattacaaaaccgggagaagcgacagagcttgcttcattgataaaagtggagggaggctacccggaaaaaggaagcctgtccttaatgactgttaaagtgggaccggctaatccgtttacatatgtgtgggcaaagatgcacccttattatgaaattgttcctgatgagagcattaaggaggaaggcgaatcagataaggagtatatgaaaagacagctccaaatgatgaaaagctcgcaagaaaatgcggttatagccgcctatcaaaaggcaggaaaaaaagtcagctattcctttaacggcatatacgcaagctcagttgtagaaaacatgccggcaaaagagaaaatagaagtcggtgataaaatcatcagcgcagacggcaaaaactatcagtctgctgaaaagctgattgattatatcagcagcaaaaaagcgggagataaagtcacgttaaagatcgaaagagaagaaaaagaaaagcgtgtcacccttacgttaaaacaatttcctgatgagccggatcgggcaggaatcggagtttcgctttatacagacagaaacgtgaaggtagagcctgatattgattttgaaatcgaaaatattggcggcccgtcagcagggttaatgatgtcccttgaaatttataatcagctgacaaaaccagacgaaacaaaaggctacgatattgcgggaacaggtaccattgatgttgatggaaaagtaggcccgatcggcggcattgatcaaaaagtcgtcgccgcagacaaagccggaaaagacattttcttcgcgccaaatcaaaacggcgccagcaattccgattataagaacgcagtaaaaacagcaaaagatattgattcaaatatgaagattgtgcctgttgataccatgcaggatgcgattgattatttgaataagctgaaagcgaaaagcacctgattctcaggtgctttttctatacatttaaaaagtgttgttcatcttcgtcatatcgaatcggtgcatgtccgtattccttcaggtcaaactcagttctcagcggctcttctatcggcaggctgtaaatcctgcttgcttttacgtccagatcgagagctggatgggagaaagaggacagtttgctgacaagcggaacagacagtgcttttttcttttcggataaataagcctgtccttttttcgtcatgccgagaagcctgatatacggcaccttatcgttgtcaagcagcttttgcatatccagtttttttgttctggttaaaatgtgtgtattcatccgctggagccttgtccacgtatagcgttttgttttcagcagctccataaattcctgataggagctggattttctgatcgaacgaagaattctgtgctctaaaccttcctccacctcgtatacttgctgtaattcctgtgctgttacagttgaaaggctgtattttaagtaagaaaagtagctctcaggtgtatgccacaatccgaaagatttgcggtaagctgctaattcacgtgcagatgcagcagggataaaacgaaggcaagcttcgagattctggccagtcatcgcttttctaatgcttgtggcgcttgcgatatggttttcgccttcagggagatcggcatcatgatagtccgaagagattcgtgccgtagtataaggtttcataggatatcccccggttagaatcgaggtcacatactggcatcccaaaatgttatttggttttgacaagtcaagtgcactttcagtatgcaaaatggagctgaaggcgctagccgccgctgctgggtaactggccccctttttaagttcttctttaattcggtcattcaatatatgtttatgctcatcaataagctgtgctgtttctaaaaaaggcttgatatccccattttcactcccgaaaaacagcgcctcacattcaagttcgttcaggattgaaacactgccgcgtgcaaaaatgtctgctttttgcacggcataaagataaggcagctcaatgacaagatcaactccgctttgcagcgccatttttgttcgggcccattttgatacaacagcgggctccccgcgctgtaaaaaatgcccgctcatgaccgcgacagccgtgtcacatccggtttgccgctttgctgtttgggcatgataaaggtgaccgttatgaaagggattatattcaaccaccaatccgacagctttcatattttttccgcctttcttgctatgtttaaaaacgtatggtacatttgcaaatgaaaactcttacgccttatttttgttttaagtgtatgcatagcatattccgctgtcaacgatacttcaatggcagcattatgctgtaaagaaaaaatattgacaaaaacaatcttaaaagctataatcatgtttgttgctttcctgaggtgatacaaatgaaatggacgatttatcagctgcatcaaatgccaaaacaaagttttgagtttgatgaaacagttgagttaaatgagctgacaaagctgaattctgacattcgccgcatttctcccgtccgggtgaagggcagagcggatatcaaatccaaacaggtttcgtttgattttacaatttcaggcgaaatgattttgccatgctcaagaacactcgttgatgtcccgtatccatttgaaatttcaacaaaagaactgtttatatttcatcacacggatgatatagaagatgatgacgttcacattgttgaggacgatactatcgacttaactccgatcgtgaaagaagaaattcttttagaaatccctatgcaaatcttttgtgaatctgaacaagaaaaaggagctgctcctcaagaaggaaaggattggcaagttatttcggaagaagacaagaagaatcaagttgatccgagacttgcagcccttgaaaagctcttaaaacaagatgatgaatcttaactctttaaggaggtgggaataatggctgtaccttttagaagaacttctaaaatgaagaaaagattgcgccgtacacatttcaaacttaatgtacctggtatgacagaatgtccgtcatgcggagagatgaagttgtctcaccgtgtatgcaaagcatgcggatcatacaacggcaaagacataaatgtaaaaagtaactaataagaaaagcgcggggtgaaagccctgcgctttttctttttctcttcctgtcagcttgcggaaaatttgtgagtgcaaatagtctatctaatctattaccggcatatgtatgagataaataagctgacatggagggagattgaatttgaccattacaagacaagatgcttggactcaggatgaggatttgctgctggcagaagtggtgcttcgtcatattcgagagggaggaacacagctttctgcctttgaggaggttggaagggcgctgaccagaaccgcggcagcctgtgggttcaggtggaactcgtatgtgagaaaacaataccagtcaggtatagagcttgcaaaaaagcaaaggaaagaactgagaaagcaaatcggcgttcattcggtcaatatgccgaattccatgaagcagactgcctcggcatcgtcggaaggaaaacgagatttgtccattcaggatgtcattcaatttctcgaacaattcaaagaagcaccgtctgcacaagaatttcagcttgaaagggaaaaattgaaggagcaaatccaatcgctgcaaaaagagcttgaggatttgcggagtgaaaatcagacattgcggaatcagctagagatgacagaagaggattacaaggcactgatcgatatcatggatcgggccagaaaaatggttgtttcgaaggaagacggaagaatgaaaaaagcggctcaagaaacataaagaaacgcctgaaatgaaccggccctatagtaagaataggccggttgtttttatttctatgcagactctcccggtgtcatttcgcgatccatatcaggatgccagatgagcgggttttcccctttgtcccgcgccatatcatacttaacagttttaaagttcattttgttccaaaattccgctgatttcattctcggatttgtccggatcggcattttgaatgattttgcaaattcaaccaaggctctcccgtatcccctgttctggtagcccggaagaacctcaagcttccacagctccaaataatcctggcggttgtcaaaatagggattcgatttgccgttaacttgatacagactcattcgtgctacaagtttatcgccaaaataaatcccgtaaaaaggcgaggtgctgtcattttcaataatattatcctgaagttcttcaagcattgaaagctcctgaatgccgtattctttgaatttcttgaattcttccagcgttttatagttgataagcagacgttctacctttgtcaaacaaatctccccctttggtgtttctatatatattgtaaacgctttatttaaaaaatccaaatatttaaactttaattttaagcacatgggatctttgagaagtaatttcttcttacttctgctatgataatacgtaaatgctaaattgggtgtgacatcatgaaaattggaattatcggcggaggctccgtcggtcttttatgcgcctattatttgtcactttatcacgacgtgactgttgtgacgaggcggcaagaacaggctgcggccattcagtctgaaggaatccggctttataaaggcggggaggaattcagggctgattgcagtgcggacacgagtatcaattcggactttgacctgcttgtcgtgacagtgaagcagcatcagcttcaatctgttttttcgtcgcttgaacggatcgataagacgaatatattatttttgcaaaacggcatggggcatatccacgacctaaaagactggcacgttggccattccatttatgttggaatcgttgagcacggagctgtaagaaaatcggatacagctgttgatcatacaggcctaggtgcgataaaatggagcgcgttcgacgatgctgaaccagaccggctgaacatcatgtttcagcataaccattcggattttccgatttattatgagacggattggtaccgtctgctgacgggcaagctgattgtaaatgcgtgtattaatcctttaactgcgttattgcaggtgaaaaatggagaactgctgacaacgccagcttatctggcttttatgaagctggtatttcaggaggcatgccgcattttaaaacttgaaaatgaagaaaaggcttgggagcaggttcaggctgtttgtgggcaaacgaaagagaatcgttcatcaatgctggttgacgtcattggaggccggcagacggaagctgacgccattatcggatacttattgaaggaagcaagtcttcaaggtcttgatgccgtccacctagagtttttatatggcagcatcaaagcattggagcgaaatacaaacaaagtcttttgagctttttcggtaacatgctatactcatttcggatcactaactatttattggagaaaggaagttctagaagatgcagctaactgaactttccatcaaaaatcagaatgtgtttgtacagcactatatagatggcaaagaagaaatgtcttctttttttgattacagtattcatcataaggacatgtggcgcgaaagactggaagacttatcttcccggtttttcgcaagagaggaattggcggcgtacttaacctcttaccataataaattcggttcaagtgcgatgcagtctgctattgagaagctgaaggacccgtcaagtgccgctgtagtcggcggacagcaggcaggacttttaacaggaccgctttacaccatacataaaatcatttcaatcattgttttagcaaagcaacaagaaaaggaactgcaaatgcctgtcataccaatcttctgggtggctggagaagaccacgatttggatgagattaattttgttcacacatctgaagagaatgggcctgtgaaaaaaaagctgcctcagtcttattggaagaaatcatcagcagcgagtacatcgcttgatcaggaaaagtgtgccgcgtggatagatgatgtttttgccgcttttgaagaaacagaccatacgaatacacttctcgacaatgtgaaacgatgtttaagggaatctgttacgtttactgacttctttgaactgctgatcgcggatttgttccaagaagagggcttagttttattaaattctggagatccggggattaaaaagctggaaacggccatgttccaaaagattcttcgagaaaatgatgaactcgcccgggctgtatcagatcagcaggccttcatgcgtcaagcaggctacaaaccgattatcgagtccggaaaagagcaggcgaatctgttttatgaatacgaagatgagcgttttttaattgaaaaagataacggccgatttgtcatcaaagagcttgatctaggatggacgatggatgaacttcatacacatatggaagaacatccagagcgtttcagcaacaatgttgtaacgagaccgttaatgcaggaatttctcattccgactttagcatttattgcagggcctggagaaatcaattattggggcgagctcaaacaggcttttgcggtgatgggcttcaaaatgcctcctgtcatgccaaggctgaacattacgatacttgagcggcatattgagaaaaaactggctgaacggaatatctcgttacaagacgcgattgagcgcggaacggagaatcaaagagagacatacttcgagcgccagattccggaagagtttacggcggtgatggatcaggcgaaaagccaaattgaagcgattcacaaaacggtccggcaggaggcgttaaaggttgatcaaagcatggaacctttactcctgaaaaatgccgcttttattcaggatcagcttcaattcttagagcgcacggtgacgaagcgaattgaagaaaaagaaggctacgttttgaaggattatgaaagaattcaaaatagcattaagccgcttcttgcgccgcaggaacggatttggaatattatgtattatttgaacaggtacggtccaaaattcttcacgacattcaagaatctgccattttcttttcaaaatcaacatcaagttgtcaaactttgaaataaagttttaaagaaccctgaatagttcagggtttttttttatgggtaaacagtgtaaaatgaagttgtggagcgaagtggtgaatagtggtgagttaaggagagaaagtggggcaagagatcatgtttatgggtgaatatcagcataccatcgatgcgaaaggccgcatgatcgtacccgctaaattcagagaaggcctgggtgagcaatttgtgctgactagaggacttgaccaatgtctcttcggctaccctatggacgaatggaaacaaattgaagaaaaactaaaagctcttcctctcacaaagaaagatgcccgcgcgtttacccgtttcttcttttcaggggcgactgaatgcgaactggacaagcaaggcagggtaaatatcgcatcatctctattgaattacgccaaactggaaaaagaatgtgttgttatcggggtttctaatcgaattgaattgtggagtaaagtaatttgggaacaatacacagaagagcaagaagattcatttgctgaaattgctgaaaacatgattgggtttgatatataatgattcttcgtgtataacactctaaaaacaatttcaattcatcctgataaaaggtgggaccaacacaatatgtttcaacacaagacagtacttcttcgtgaaaccgtagacggactcaatattaagccggacggtacatatgtagactgcacactcggcggagctgggcacagtacatacttattgcagcagttatccgagaaggggcgtttaatcgcttttgaccaagatgatacggcattacagcatgctaaagaagtgttgtccgactataaaggacagctcattctgattaaaagcaatttcaggtatttaaaagaatgtttgaatgaacaaggcattacagaagtagacggtattttatttgatttaggggtgtcctctccgcagctggatacaccggagcgcggattcagttaccatcatgacgcaccgttggacatgaggatggaccagtcggctacgcttacggcgaaagaagtcgttaatgagtggcgctatgaggatctcgtccgtattttctttaaatacggagaagagaagttcagtaaacagatcgccagaaaaattgaggaggcaagaatgaagtctcctattcaaactacgggccaactggtcgatctaataaaagacgcgattcccgctccagcgagaaggagcggcggacatcccgctaaacgcgtgtttcaggcaatcagaattgccgtaaacgatgaacttagggtgtttgaagaagctttggagcaggcaattgaggttctgaagccagggggcagggtatcagtcattaccttccactcgctagaagacagaatttgcaaaaccacttttaaagaaaagtcgtcgcttccggaacttcctccgggacttcctgttataccggaagagtttgaaccggagctgaagctcatcacacgaaaaccgattacggcatctcaagaagagcttgaagagaacaaccgggctcgttctgccaagcttcggattgctgaaaaaagaaaataacgaaacgcgaacgcaaaattaaaaggaggtcatcagcctatgagcaatttagcttaccaaccagagaaacagcagcggcatgcgatcagtcctgagaaaaaagtgattgtcaagaaaagggcttccattactctcggagaaaaagtgcttcttgtcctctttgctgcggcggtgctcagcgtatcgcttttgatcgtatcgaaggcgtatgcggcatatcaaaccaatattgaggtgcaaaagcttgaggagcaaatttcatccgaaaataagcaaattggtgacctcgaaaaaagcgttgctgatttaagcaaaccgcagcgcattatggacattgcgaaaaagaacggcttgaatttaaaagataaaaaagtgaaaaacatacaggaatgattcaaatgccaaaaaagaataaatttatgaatagaggagcagcgattctaagtatttgtttcgctctctttttctttgtcatcctggggagaatggcatatattcaaataaccggaaaagcgaacggcgaagtgcttgcgacaaaagcgacagagcagcatgaaaagaaacggaccatcgaagcgagccgcggctcgattttagaccgaaaaggaaaagtcattgcagaggacacagcgacgtataaactgattgcgattctcgataaaaaaatgaccactgatgtcaagcatcctcagcatgttgtaaacaaagaaaaaacggcggaagcattgtctaaagtgataaacttggacaaggccgacatccttgatatcttaaataaagatgcaaaacaagtcgagtttggctcagctggccgggatattacgtattcacaaaagcaaaaaatcgaaaaaatgaaactcccgggcatttcatttttacgggatacaaaacgctactatccaaacggagtatttgcatctaatctaatcggctatgccgaggttgatgaagaaacaaatgaaatttccggcgcgatgggattagaaaaagtgctggataagtatttgaaggagcgcgacggatatgtgacatatgaaagcgataaatccggctgggagctcccgaacagcaaaaataaaattacagcgccaaaaaatggtgacaatgtatatttaaccattgaccagaaaattcaaacctttttggaagacagtatgacaaaagtggcgcaaaagtataatccgaaaaaaatcatggccgcagttgttgatccgaaaacaggcaaagtgcttgccatgggacagcgcccaagctttgatccgaacaagcgcgatgtgacaaactactataatgatttgatttcatatgcgtatgagcccggatccacgatgaagatttttacactcgctgctgcgatgcaggaaaacgtgtttaatgcgaatgaacaatataaatcagggacctataaagttggcggcggaaaagtatatgaccataacgggggtgtgggctggggtcccatatctttcaaagacggggtgcttagatcctctaacgttgcttttgccaaattagcaaatgaaaaattaggttttgatcgttataatgagtatttgcataaatttggtttttatcaaaagacaggaatcgatctgccgggagaagcatcaagtaaaatgaactttaagtatgattacgataaagcttcaactgcatacggccaagcatctgcagtcaccccgattcagcaactagaagcagcgactgccgtcgcaaatgatggcaaaatgatgaagccttatgtcattgatcatattgttgatcctgatacgaagaaaaccgtttatcaaaataaaccggaatctgcaggaacaccgatctctgccagtacagctaaaaatgtgcgtgatatcctgggagacgtcgtttcatcagacattggaaccggacgcccttataaaattgagggctttgacgtggctgggaaaacaggtacagcacaaattgcaggaacgaatggttatttaaagggacgggataactatattttctcatttatgggaatggctcctaaagataatcctgagttgttgatttatgttgcggtacagcaaccgcaattagaggatgatgaaactggctctgatccagtatcagaaatcttcaatccaacaatgaaaaatagcctgcactacctaaacatcgaaccaactgaaaaatctgactcagataaggaagaaacaaaagcgcagacaatgcctgatttaacagatcaaacggtagctgctgctcaaaagaaagcaaaagaggagaatctcacaccaattgtcatcggcagtgatgtcgctgtaaaagaacagtatccgaaagcggatgaggaagttctcaccaatcaaaaggtcttcctgaaaacgggcggcaaaatcaaaatgcctgatatgacaggctggtcgagaagagaggttctgcagtacggcgagctcgcgggaattcatattgaagtaagcggacaaggctacgctgtcaaccaaagtgttaagaaagacaaagaaatcaaagacaaaaccgtaatcaaggttaagtttaaaaatcctgattaaaaagaaagcctgcgttatgcaggctttctttttttatgccttcagaggagcatcgttctacctgtccaatttcaggcataaaatgaaacaagcctaaataaggagtgaacggtctcttgcgcgtctcgaatgtaacggttagaaaacgtttattatttgttttgctttttggcgtgatcgtgtttctgatcattgatacaaggctggggtatgttcagtttgtgatgggcgaaaaactgacttcgctagcgaaagattcctggagccggaacttgccgtttgagccggagagaggcgagattctggatcggaatggtgtgaagctcgcaacaaataaaagtgcgccgaccgtattcgtcgtgccgcgccaagttcagaatccgatgaaaacgagcaagcagcttgcggcggtgctcaatatgtcagaagaaaaagtatataaacatgtgacaaaaaaagcgtcaatcgaaaagatcactcctgaagggagaaaaatttcaaatgagaaggcgaaagaaatcaaagcgcttgatttaaaaggtgtgtatgttgcggaggacagtatccgtcattacccgttcggcagctttttatctcatgtgcttggatttgcaggaattgacaaccaagggctccttggacttgaagcctattacgacgatgatttaaaaggggaaaaaggttctgttaagttttatacagatgccaaggggaagaagatgcctgatgaagcggatgactatacgccgcctaaggatgggcttgacatgaagctgacggttgattcaaaggtccagacgataatggaaagagagcttgataacgctgaggccaaatatcatccggacggcatgattgccgtagccatgaatccgaaaaacggagaaattttggggatgtctagcaggcctgacttcgatcctgctgattaccaatctgttgatccgtccgtctacaatcgaaatctgccagtatggagcacgtatgaaccgggatctacctttaaaattattacacttgcagcagcccttgaagagcaaaaagtaaatttgaaacgggatcaattttatgataaagggcatgcggaagtggacggagcgagactgcggtgctggaaaagaggcgggcacgggctgcagacgtatctggaagttgtgcagaactcctgcaacccggggtttgttgaattaggcgagcgcttaggaaagaaaaagcttttcaaatatatcaaagactttggttttggacaaaaaacggggattgatctccaaggcgagggaacaggcatcttattcccgcttgagagagtgggcccggtggagcaagcaactacggctttcggacagggagtatccgtcacgccgattcagcaggttgcagcagtatccgccgctgtaaacggaggaacgctctacacaccttatattgcaaaggaatggatcgatcctgttacgaagaaaacggtcaaaaaacaatcaccaatcgcaaagaaacaagtcatttctgaggaaacatccaaacaaatccgctatgctctagaaagcgtcgtcgcagaaggcactggccgcaatgcatttgtagaaggatatcgtgtcggaggaaaaacgggaactgcacaaaaggttaaagatggaaaatatcttgaaaacaaccatattgtatcatttattggtttcgcgcccgccgatgatccgagtctagtcgtctacgttgcggtggataacccgaaaggcacgattcagtttggcggaacggttgcagcgcctattgtcggaaatattatgagagacagtctgccggaacttggtgtgaagccccggaaaaatcaaatcgagaaaaaataccaatggaacgacacaaaaacaatagaagttccgaatgttgtagggatgtctgtctcagatcttgagtcactattggtgaatctcaatgtggatgcttccgggaaagggagcaaaatcgttaaacaatcgccagctgccggaacgaaagtaaaagaaggctcaaagatacgcgtgtatttgactgaagaagatgaaaaggaggcagccgattgattcggactgcctattcttttattgcagaaaaaatgctgatatctttcaagattagctggatgtatccttttatttacgctaaaatatgaactgtatgcttaaaatcattaccacatcatttgatgtgacttcaatgataaaaagaacgaattagaatgttgagaggtttgatacgatgaaacttacaaagctgcttacatacttaacaaccgaaccttctgtaaacgactcacaagaccctgaaataacttcaattgagatggactccagggaagtaaagaaagggagtctttttgtatgtgtaaaagggtatacggtggatggccacgattttgcgcaaaaagcagtagaaaacggtgcagcggctattgtggcagaaagagaggtcgatgtgaatgttcctgttattattgtccggcagtcacttcgcgcgctcagcgttttgtctgatgcgttttacggacagccgacgaagaagcttcagctgattgggataacagggacaaacggcaaaacatcaacgacccacatggtcgatgagattctgaaaaaagcgggaaaacgcacaggcttgatcggtacaatgtacatgaaaatcggagacgaaacacttcctgttaaaaacacgactccggaaagcgtcacgctgcagaaaacgtttaagaaaatgaatgacaagcacgttgacactgctatcatggaggtttcttcccacgctttgtctttaggacgcgtccatggctgtgattatgatattgccgtgtttacgaatttaacacaggaccatctggactatcataaaacgatggatgagtaccggcatgcaaaaagcttgctcttttcccaacttggcggggctttcaaccatgaacatccaaagcgtgccgtactgaatgctgacgatgaggcgagcgcttattttgaaaaggtaacagctgcgcatatctctacatacggaattaaaaacgatgctgatgtgatggcgaagaacatcagtatcactgcacagggcacaagctttgatctcgtgacaaacaaaggcacgaagcacatcacgatgtctctcgtcggacaatttaatgtgtataacgtgctggccgctgttgcaacatgtattgcagcaggcataccgtttgaaatcatcactgaggctgttgaagaattgcatggtgtaagaggacgttttgaattggtcaatcagcagcaggagtttcctgtcattgtagactacgcgcacacaccggacagccttgaaaatgtgctggagacatgcagagacatgacggaaggaaagctatttgtcgttgtcggctgcggaggagacagagataagacgaagcgcccgaaaatggctaaaattgctgtggagctggctgacgagccgattttcacgtcagataacccgagaagcgaagatcctcgcgcgattttaagagatatggaagccggagtagagaacgcatactatcacagtattgcaaaccgcgagcaggcgatctttttcgcaattgccaatgccaaaaaaggcgacgttgtcctcattgccggaaaaggacatgaaacctatcagcagatcggaaatgaaactttcgattttgatgatgctgaagtagcggcgagagccattgttgaactcaataagaataagacgaattcataggaaagagatgttactgaataatggagcttaaaaagatttttcatatggaaaaaaatcatgaatatgataactacgtatgtcgtttgaaagaaacaggaggagaataggacaatgcttgagcaagtcattctgtttacaattttaatggggtttttaattagtgttctgctctctccgattcttattccgtttttaagaagattaaaattcggccagagtattagagaagaaggaccgaaatcacatcagaaaaaatcagggacaccgacaatgggcggggtcatgatcatactttctatcatagtgacaacaattgttatgacacagaagttttcagaaataagccccgaaatggtgctgcttctgtttgttacgctaggctacggtttgcttggctttttagatgattacatcaaggttgtcatgaagcgcaatcttgggttgacatcaaagcaaaagctgatcggacaaattattattgcagttgtattttacgctgtgtatcattactacaattttgcgacggatattcgcattcctggaactgacttatcatttgatcttggctgggcttactttatccttgtgctctttatgctagtcggcggatcaaacgcagttaacctgactgacggccttgacgggttattatccggtactgcggcgattgcctttggcgcctttgccattctggcatggaatcagtctcaatatgacgtagcgattttctcagttgccgttgtcggtgcagttctgggcttccttgtatttaatgctcatccggccaaagtttttatgggagatacgggatcgcttgcattgggaggagccatcgttaccattgccattttaacgaaattagagatcctgctggttatcatcggcggtgtattcgttatcgagacattatccgttattttgcaggtcatcagctttaaaacgacaggtaaacgaatctttaaaatgagtccgcttcatcaccattatgagcttgtcggctggtctgaatggagagtagtcgtgacgttttgggctgcgggacttttgcttgccgttttaggaatttacatcgaggtgtggttataagtggaaaatgatcaatttttacagaaacagcattttttaatccttgggcttgcgaaaagcggatatgcggcggcctccattcttcatgaaaaaggcatttatgttgcagtcaatgatcaaaagccttttgaagaaaatgaaccggcacaaaagctttctgaaaaaggaatcgaagttgtttgcggagagcatccagtttctctgttcgatcagcatcaaatcacgattctgatcaaaaacccgggaattccttatgaaaatatcatggttcaggaagcagagaaacgaggcattccggtttggacggaaattgagctcgcttactacctgaccagcgccaagtttatcgggattaccggatcgaacggtaaaacgaccacgacaacgctaatttacgaaatgctcaaggctgactcgcaaaaagcactgattgccggaaacatcggcacagtcgcaagtgaggttgcctatcatgctgatggagatgaatggatcgttaccgaactgtcttcgtttcagctgatgggaacacacgctttcagaccggaaatcagcctgattttaaatgtatttgacgcccatctggattatcaccatacgcgcgaaaactatgaaaaagcgaaacagaaagtgtaccttcatcagactgcttcagataaagccattgtcaaccaggatgatgaaaccgtcgtgcgtcttgctgaagccggaaaagccgaaatcgtcccattttcagtcagcaaaacgcttgaacagggcgcatatgtaaaagacagtatgattatgtttaacggcgaagccattcttcctctggaagaggttgtactgcccggtgctcataacctggagaacattttagcagctattgcagttgtgaaaacggcaggagcatccaatgaggcggttaaaaaggtgctgacaagctttactggtgtgaagcaccgcctccaatatgtcacaactgtgaatggccgcaaattttataacgacagtaaagcaacaaacattctggcgacaagcaaggcgctttcagcttttgataagccggtcattctgcttgcgggcggactggatcgcggaaatggttttgatgacttgaaaccttatatgaagcatgtcaaagcagtgcttacatttggccagacagcgccaaaactcgagaaactcggcaatgaactgggaatacaacatgtcaaacgtgtcgataatgttgaacaagcagtatctgcggcgtttgcgatctcaaatgaaggagatgtcatcctgctgtcacccgcgtgtgcgagctgggatcaattcaaaacatttgaagaacgcggtgacatgtttatagatgccgtgcatatgcttaagtaagggcttgtcttgaagtaaatcggcagccctaatgactttaagcttggggtgtcgattgctttgactactaaaaaaacatcgcctgatttgttattggtcatcattacgttattattattaacaatcggattaattatggtgtacagtgcgagtgcggtatgggcggattataaatttgacgactcattctttttcgcgaaacggcagcttttgtttgcgggaatcggcgtcattgctatgttttttatcatgaatgtcgattattggacttggaggacatggtccaaattgctgatggttatctgctttttccttctggtgcttgttttgataccaggcgtcggaatggtgcggaacggttcaagaagctggatcggagtcggtgcattcagcatacagccttcagagtttatgaagcttgcgatgattgcattccttgctaaatttctctctgaaaaacaaaaaaacatcacatcgttcagacgggggttcgtccccgcacttggcatcgtgttttcagcatttttgattatcatgtgccagcctgacctcggaacggggacagttatggtcggaacttgtattgtcatgatttttgtagccggcgcacggatcgcccatttcgtctttctcgggctgatcggcctcagcggatttgtcgggctcgtactatcggctccatatcggataaagcggattacctcatacttaaatccatgggaagacccgctcggaagcggatttcagatcattcaatcgctttatgcagtggggccggcgggttgttcggaatggggctcggacaaagcagacagaaattcttttatctgcctgagccgcaaacagactttattttcgccatcttgtcagaggagctgggctttatcgggggaacacttattttgctcctcttcagcatcctgctgtggagaggaatcagaattgcgcttggtgcgcctgatctgtacggaagctttgtcgcagtcggcattatttcaatgattgccattcaagtcatgataaatatcggcgtagtcacgggcctgattcctgtaacaggcatcacgctcccgtttctgagctacggaggctcttcattgactctaatgctgatggcagttggtgtgctgctgaatgtaagccgctactcgaggtattaacgaatgtatgtccaagcttcctgtctaacatgaagcttggaaacaattgatgcgataaccctgtccaacaaaacagggttatcgttatgttatagagaaacttagactgggggaaaagaaatgcgaattgcaataagcggaggcggtacagggggacatatttatcctgcgcttgcttttattaaagaagtgcaaagacgtcatcctaatgtggaatttttatatatcggaacagaaaacgggctggagaaaaaaattgttgagcgggagaatataccgtttcgttcaattgaaattacaggatttaaaagaaaattgtcatttgaaaatgtcaagactgtgatgcgttttctgaagggcgtcaaaaagagtaaatcgtatttagcggaatttaagcccgatgccgtaattggaacgggcggttatgtatgcgggccagttgtctatgccgctgcgaaaatgggaattccgactattgtccatgaacaaaacagcctgccgggtatcacgaataagtttctttcaaaatatgttaataaagtagcgatttgttttgaagaagcgaaatcacattttcctagcgagaaagttgtatttacgggaaacccgagagcctctgaagtcgtctcaataaagacgggacgatcaatggctgaatttgggctttctgaagacaaaaaaacggtcttaattttcggcggaagccgaggcgctgcaccgattaaccgcgctgtcattgacatgcaggatgcgctgaaaacaagagactatcaagtgctgtatatcaccggtgaagttcactatgaaaaagtaatgaatgagctgaaaagcaagggtgccgctgataatatggtcacaaagccgtttcttcatcaaatgcctgagtatttaaaggccattgatgtcattgtggccagagccggtgcgacaacgattgccgaaattactgctctcggaatcccaagtgttctgatcccgagtccatatgtgacagcgaatcaccaggaggtcaatgcgagatctctcggccagcatgatgcggcgattgtactgaaagaaacagagctcagcggggagaagctgattgaagcgctagaccggattgtactgaatgagcaaacgttaaaggaaatgagcgaacgaacaaagtcactcggtgttcctgacgcggctgcccgtttatacagcgtactcgaggaattaaaaaaatagtagaaaagcaaatggaatgcggaggtttacgatggagaaagtgatacaggaattaaaagaacgcgaagtcggcaaggttcttgcaaatgaaccgctcgcgaatcatacaacgatgaaaatcggcggacctgcggatgtattggtcattccaagcagtgtagatgctgttaaagacatcatggacgtgattaaaaaatatgatgtgaagtggacagtcatcggccgcggatcaaatcttcttgttttagatgaaggaattagaggcgtagtaatcaagctgggtgcgggtcttgaccatttggagcttgaaggggagcaagtaacagtcggaggcggttattcagtggtccgccttgctacatcattgagcaaaaaaggcctgtccggtttggaatttgctgccggcattccaggatcagtcggcggagcggtttatatgaatgccggcgctcacggttctgatatgagcgagatcctcgtcaaagcgcatattttatttgaagacggaacgattgagtggctgacaaatgagcagatggatttcagctataggacatctgtactgcaaaagaaacgcccgggcgtttgccttgaagctgttttacagctggagcagaaggataaggaatcaatcgttcagcaaatgcaaagcaataaagactatagaaaaaatacacagccgtattcaagcccttgtgcgggaagcatattcagaaatccgcttccgaatcatgccgggaaccttgtagaaaaagcaggcttgaaaggatatcaaatcggcggtgcaaagatatcggagatgcacggaaacttcatcgtcaatgcgggggagcatcagcaaaagatgtgcttgatctcattgaccatgtgaaaaagacaatccgtgaaaaatacgagattgatatgcacacagaggttgaaatcatcggcggaaatcgctgattcaagttctgactgaagctgttcatatgatatactgtaagcaaacgacaaacggcatcatagtatgccgtttgttttggaatagacagacttttaacagctgtttcatttgaatgaggtgaacaggcaatgaacccgggtcaagaccgagaaaaaatcgttaacattgaagagcggatccctaaaattaaagagcagaggaaacaaaaggcaaaccgccgtctcatttcatttattatgctcttttttattatggtgctgatcattgtgtacctgcaaacaccaatcagtaaagtatcaacaatctctgttacagggaatgaaaatgtatcaaaaaaggaaattatcgacctttccgatattaatagcggagatactgagttttggagtttggacaagcaaaaaacagaaaagaagattcagcaaaataaattagtgaaaaaagcggagatcagcaaatcgcttcctaataaaatcaacattgcaatcgaagaatataaagcgattgcttatttagaaaaagacgatgtgtactatgaagtgcttgaaaacggctcagttctgccaaacgaagtaacgccagatgatgccggaccgattttagtgaattggacaaacgcgaagaagcggtctcaaatggccaagcagctcgatgcgttgtcaaattcgttaaaacagtcgatttcagaaatttattatacgcctgtaaaaatggatgaaaaccgtattaagttgtacatgaacgacggttatgttgttactgcatctattaaaacgtttgcagaccgaatgaagacgtatccttctatcatctcacagctaagcagcaataaaaaaggaatcattcatttagaagttgccacctattttgaagagtttggaaaaaacgataaagctgctaaaaaggaagatgaaaattgaggggcaaatcagcagtccttctttccttgattatgcttatcgcaggctttttgatttcattttcttttcaaatgacaaaagaaaacaacaaaagcgcggctgagacggaagagtggaaaaaagaatatgcgctgagagatgaacttctgaaacaagagaaagaaaataagaagcttgaaaaagaattatatcaaaagcaaaacaaagtccgccaggcggaaaataagctgaagaaagagaagacggaatactataatgtcctcgaagatacagaaaaatacaggatgtatattggggaagtcggtgtgcagggagaaggcgttgaggtgacattggaagatgcgtcatacatacctgaaggggagaatgtgaatagttacatcgttcacgaaagccatatcttccaagtagtaaacgaactgtatatctcaggagcggcggctgtcgccgttaatgggcagcgtttgacgcatgattcgtatatcaaatgcaatggtcctgtggtaacggtagacggggtgcagcatcccgctccgtttacggtatccgctattggagatccagatgtcctgctgccctcgttaaatatcgcaggaggcctaattgatcagctgtcaatggatcatatttctgtttcggcagaaaaagagaaaaatgtacaaatgaaaccgattctgaaaacgaaggaatgactgaaaaagcgggtgaaatagattgaaaataaagcgttccttcataagcatcagtgtgcttatggtcatcttcggcctgatgatatctgttcagtttaattcgttaaaacaccccaaagtccgggatacaagagatatgtgggatattagggaagagctgacatcagagcagaagaagcaggaaaagctgctggctgaaataaacaaatatgacaaactgctgaatagctattcgcaaacgaaagaaatgacaaaagaaaccgcgctaaataataccttgcaatccttaaaaaaaacagccggcatgaccgatataacaggtagcggaattgtcattacgatttccccgcttttttctgaaagcttaacaggagagccgatcgaaaatccgcctccggatttgctgaaaaagctgattaatgaactcaactcctacggtgcagagcatatctcgattaacgagcgaagagttgtgaatcatacagtcatcagagatataaacggcactacaaaaatagacggatacgcccttgacgattatcctttaacagtaaaagtgcttgccaaagatccggacatgttacacagcagagtgaaggggtcaggccttgaggatctttttgcatctgaaaatttagcattaaaagccggtaaatctgaaagcaaactaacattaaaagcatatgacagaccactggacgtacaacagctgaaactgcttaaagactgaaaaggaggagaattgtcatgtggctgcccgtgttgggactggtgctcggaatagcgattggactaatgacaaacttaacgataccgagtgaatactcaaactatttatcgcttgcggtgcttgccgcacttgatacattaatcggtggaatcagggcgcatttacaaggtacatatgatgaaatggtatttgtttccggtttcttttttaatattatattggcaataagtttagcttttctgggagtccatcttggtgtagacttgtatttagcaggtatattcgcatttggagtcagattatttcagaatatagccgttatcagaagaaatctactaacaaagtggactctttctaaaaaaaataaaaaaaatgtgatataaaagaggatatacataggatataacgaatattttcaataaacataaaatgtgaaaagcacataaaaatattctgttgttattttttgttacacacttgtaaagccacattcattgtattgttgttccgcaaataatagaatagaaatgatcgaaatgtgaggaggtgccatagaatgaacaacaatgaactttacgtcagtcttgacatcggtacgtccaatacaaaagtgatcgtcggagaaatgacagatgattcccttaatattatcggtgtgggaaatgtaccgtctgaagggttgaaaaaaggctcaatcgttgatatagatgagaccgttcattctataagaaaagcgtttgaccaagctgaaagaatggtaggttttccgcttagaaaagctattgtcggcgttaatggaaattatatcaatattcaagatacaaacggtgttgtagcagtttccagtgaaaataaagaaattcaggttgaagacgtacgccgtgtcatggaggcggcacaggttgtttcagtaccgcacgaacagctgattgtcgatgtcattcctaaacagtttatcgtagatggaagagatgaaatcaccgacccgaaaaaaatgctgggggtgcgtttagaagtagagggcaccttgatcaccggttcaaaaacaatcttacataatttactccgctgcgttgaaagagctggtattgaaataactgatatttgccttcagccgctggcagccggttctgctgcattatcaaaggacgagaaaaaccttggtgtggctctcattgatatagggggagggtcaacaaccattgccgtattccagaacggacatctcacttctacccgtgtcattcctctcggaggcgaaaatatcaccaaagatatctccatcggattgagaacgtcaacagaagaagcagaacgcgtgaaaaagcaatttggacatgcctactatgacgaagcctcggaagatgaaatatttgaggtaaccgttataggcaccaatcaaaaacaaacatttacacagcaagaagcagcgaatatcattgaagcgagagtagaagaaattcttgaaattgtttcagaagagcttcgcagtatgggaattaccgatctgccgggaggcttcgtgctgacaggaggacaagcagctatgccgggtgtcatgtctttggcacaggatgtgctgcaaaacaatgtcagagtggcaagcccgaattatatcggtgtaagagatcctcaatatatgacgggagtgggcctgatccaattcgcctgccggaatgcaagaatccaaggcagaaaaataggctttaagatgcctgaagaagcgatacaggaaatcgcagtctcatcatctgaggaacaagagcagcatcatcaccaaaatgaggtgcagcagcggccaaaaggaaaacaaaaaacacaagccgaacataataaacagagcaaaatgaaaaaactattaagcatgttttgggaatagatagatagtcattcggcagattaggaggatttagcatgttggagttcgaaacaaacatagacggcttagcatcaattaaagtaatcggagtaggaggcggcggaaacaacgccgttaaccgaatgattgaaaatgaagtgcaaggagtagagtatatcgcggtaaacacggacgctcaagctcttaacctgtcaaaagcagaagtgaaaatgcaaatcggcgcaaagctgactagaggattgggagcaggtgcgaatccggaagtcgggaaaaaagccgctgaagaaagcaaagagcagattgaagaagcacttaaaggtgctgacatggtattcgtgacagctggtatgggcggcggaacaggaacaggtgccgcaccggttatcgcacaaatcgcgaaagacttaggcgcattaactgtcggcgttgtgacaagaccgtttaccttcgaaggacgcaaaagacagcttcaggctgcaggcggaatctcggcaatgaaagaagcggtggatacactgatcgtgatcccgaacgaccgtatccttgaaattgttgataaaaacacaccgatgcttgaagcattccgtgaagcggataacgtacttcgccaaggggttcaaggtatttctgacttgattgctacacctggtcttatcaaccttgactttgctgatgtgaaaacaatcatgtcaaacaaaggatctgctttgatgggtatcggtattgctactggggaaaatcgcgcggcagaggcagcaaaaaaagcaatttccagcccgcttcttgaagcggccattgacggtgcgcaaggtgtcctcatgaacatcactgggggaactaacctcagcctatatgaggttcaggaagcagcagacattgtcgcttcggcatctgatcaagacgtaaacatgattttcggttctgttattaatgaaaatctaaaagatgagattgtggtgacagtgattgcaaccggctttatcgaacaagagaaggacgtgacgaagcctcagcgtccaagcttaaatcaaagcatcaaaacacacaaccaaagtgttccgaagcgtgagccaaaacgtgaggagcctcagcagcagaatacagtaagccgtcatacttcacagccggctgatgatacgcttgacatcccgacattcttaagaaaccgtaataaacgcggctaatgtaaaggacaaaatcgttttcgattttgtccttttttgtttttctcttcacactttccttcttataaagtctttttccctattgcttccttcgcttagtaacaaaacagataattagacctatttatttttgtgacatttttatcattttcatatatatggaaattgaatgacatgaaacgacaatatctgtaattcagattgtctacagttaatatacagcgatgttctgacaaaccattcattattaaaaggagggacgacactttttttaaaaagcatgttgaaaaaggggatgaaaatgaagaaaaaaacgaaaaacagactcatcagctctgttttaagtacagttgtcatcagttcactgctgtttccgggagcagccggggcaagcagtaaagtcacctcaccttctgttaaaaaggagcttcaatctgcggaatccattcaaaacaagatttcgagttcattaaagaaaagctttaaaaagaaagaaaaaacgacttttctgattaaatttaaagatcaggctaacacagaaaaagcggcaaaagcggctgttaaaaaagcgaaatcgaagaagctgtctgccgctaaggcggaatatcaaaagcgttctgctgttgtgtcatctttaaaagtcacagccgatgaatcccagcaagatgtcctaaaatacttgaacacccagaaagataaaggaaatgcagaccaaattcattcttattatgtggtgaacgggattgctgttcatgcctcaaaagaggttatggaaaaagtggcgcagtttcccgaagtggaaaaggtgcttcctaatgagaaacggcagctttttaagtcatcctccccatttaatatgaaaaaagcacagaaagctattaaagcaactgacggtgtggaatggaatgtagaccaaatcgatgccccaaaagcttgggcacttggatatgatggaactggcacggttgttgcgtccattgataccggggtggaatggaatcatccggcattaaaagagaaatatcgcggatataatccggaaaatcctaatgagcctgaaaatgaaatgaactggtatgatgccgtagcaggagaagcaagcccttatgatgatttggctcatggaacccatgtgacaggcacgatggtgggctctgaacctgatggaacaaatcaaatcggtgtagcgcctggcgcaaaatggattgctgttaaagcgttctctgaagatggcggcactgatgctgacattttggaagctggtgaatgggttttagcaccaaaggacgcggaaggaaatccccacccggaaatggctcctgatgttgtcaataactcatggggagggggctctggacttgatgaatggtacagagacatggtcaatgcctggcgtgcggccgatattttcccagagttttcagcggggaatacggatctctttattcccggcgggcctggttctatcgcaaatccggcaaactatccagaatcgtttgcaactggagcgactgatatcaataaaaagctcgctgacttttctcttcaagggccatctccatatgatgaaacaaagccggaaatatctgcaccgggcgtaaatattcgttcatccgttcccggtcagacatatgaggatggatgggacggcacatcaatggcagggccgcatgtatccgctgttgctgcactgctaaaacaggcgaatgcctcactttctgttgatgagatggaggatatattaaccagcacggctgaaccgctcacggattcaacatttcctgattcaccgaataacggatatggccatggtctggtgaatgcttttgatgctgtatccgctgttacagatggtttagggaaagcggaaggacaagtttctgtagagggggatgaccaagagcctcctgtctatcagcatgagaaagtaactgaagcctatgaaggcggcagcctgccattgacattgacagctgaagacaatgtgagtgtgacgtctgtaaagctgtcctacaagcttgatcaaggtgaatggacagaaataacggctaaacgaatcagcggtgatcatctaaaaggaacgtatcaggcagagatcccagatataaaaggaactaaactaagctataagtggatgattcacgattttggcggtcatgtggtttcgtctgacatatacgatgtaacagtgaaaccaagcatcacggcgggatataagcaggactttgaaactgcacccggcggctgggttgcgagcggaacaaataataactgggaatggggagttccgtcaactggcccaaatacagcagcatccggagaaaaagtatatggaacgaatttgacaggaaattatgccaactcagcaaacatgaaccttgttatgcctcctgttaaagtacctgattcaggaagtttgtttcttcaatttaaaagctggcacaatttagaggatgattttgattacggctacgtttttgttcttccggaaggtgaaaagaattgggagcaggctggtgtctataacggaaagacatcaagctggacggaagaagaaattgatttatcggcttataaaggccaaaacattcaagtgatgtttaaccttcaatcagatgaaagcattgcaaaagagggctggtacattgatgatgtagtgctttctgacaaatcagccggaaaaacagtcaaaaagaataagctgggcgtcgaaaagccgtctggaaagcaaaagaaaaagccagtaaatccgaaaaaggctaagccatctgcaaacacagcggtaaaacatcagaacaaggctatacagcctcaagttttgccgctcagggcacaagtcagtgtagtggaaacaggaaaatcaacatattcagatcaatccacagggcagtacacgctgaagcacaaagcgggagactatacgcttatggcagaagcatatggttatcagtcgaaaacacaaaaagtgtctttaaagacggatcagacgacacaagctaattttacgttagaagagatgaagaagggcacattaaaaggcacggtcatcaataaaacgacaggagagccggtaaaaggcgcttccgtttatgttgtagaggatgctgcggtggaaccggctatgacaaacgataaaggtgaatatacgctggaggcctatgaaggcgcttatacgattaaagtcgctgcaccgggttattacagtgatgaattttccgttgagttaaaaggtgatgttacaaaagaaactgcattgaagcctttcgtcggttatccgggtgaaattgcatatgatgacggaacagcggagaatgccaattcctattttgctgccggtaacggatgggcggtaaaaatgacgctggctgacggcaaggacaaaggcatgcttacaggagggctgttcagattctgggatacagagttcccagatccaggcggtacagagtttaaggttgaggtatatgatgctacaggaaaagacggagcaccgggcaagaaaattgccgggccatttaacgctgaagctcttcgcaatggcgagtggactaaggtagatctcagttcaaaagggattatggtcgataaagacttttatctcgtatatatccagtcgaaacctgacccgtattcacctggactggcaatggatgaaaccggcaagaattccggccgcaactggcagtatataggtggacaatgggagccgggtgacgaagcagacggcaactatatgattcgcgcattagttaattatgaagctgctgtacctgagattacttcaccgacagacaaatcatacacaaataaggatagcgtcactgtaaaaggaaacgcttctcctggtacaacggtacacatttataatggagagaaagaggcaggagaaacgaaagctgctgcggatggcacgttccatgcaggcatcacactcaacaagggtgaaaatgagctgacggcaactgcagcaactgacaacggaacaacagatgcctccagcccaatcacggtcacgcttgatcaagaaaagcctgagttaacgctggacactccaaaggatggcgggaaaacaaataaagaaacgctgactgtcaaaggggctgtatccgatgacaatctgaaagacgtcaaggtgaatggcaaaaaagcaacaataaccgatggttcatactcagcccggattcttttggagaatggaagcaatgaaatcaaggtgattgctacagacttagcaggcaacaaaacgacgaaaaaggctgtcattgatgtcaattttgataagcctgtcatttccggcttaattccgggagaggataaaaacttaaaagccggtgaatctgtgaaaatcgctttctcaagcgctgaggatttagatgcaacgtttatcattcgtatgccgctgaccaatgcaagagcgagtgtgcaaaatgccaccgaactcccgttaagagaaatttctccgggaagatatgaaggctattggacagccacttcttctattaaagcaaaaggagcaaaagtagaagtgatcgtacgagatgattatggaaatgaaacaagaaaaactgcgaatggaaaacttaatatcaacacagaaaattaagtggaaaaaaagctgccgtcattggcagcttttttatatatcctctcattacacttcctcgacaaattaagcagatttccctgaaaaattgtattttcctctcaacattaattgacagactttcccacagagcttgctttatacttatgaagcaagaaggggaacagcgtgaggcaagaaagaaaggagtcagatgtgaaaatctatttagatgtcatttggctgttaaacttttgttttgatgcacttttgcttttgctcacggcatttattttaaaaaggcatgtaaaaaaagaagactggtaggcggagcgttcatcggttccagtattgtccttttgatgtttactcctttttcgccgattgttgaacatccggctgggaagctagctttttcagttgtgattgtggtggtgacatttggctttaaaagatttcggtttttctttcaaaatttgttttccttttattttgccacttttttaatggggggaggaattataggagcccattctttgctgcagtcaaattctattgttcaaaacggtgtcatgattaccaatcaaacagggtttggagacccgatcagctggctgtttattgttggtggctttccagcattatggtttttttctaaaagaagaattgaagatattgaaacaaaaaacattcaatatgaggaacgagtcagcgtgcaggcagatttgggcagccaaacacttcatgtcagaggcctgattgattccggtaatcagctgtacgatcctcttacaaaaacaccggtaatgatcatttacattgataaactggagccgattttcggaacagccgaaacgatgatcattcgaaacacagacccattggaagccatcgaacagctcgatgattcctttcgctttttagataaaatgaggttgattccatacaggggagttggtcagcaaaatcaatttttattatgcgttaaaccggatcacgtaacgattatgacaaaagaagaaatgatctctgcagataaatgtttaatcggcatcagcacaacaaagctgtcggcagatggagagtttgacgcgattattcatccgaaaatgctttcgggcaaggctgtcaaacacgtttcataatgttcgcaaatgtccgttacttatcatactcaaacggcgtgacatttagaagggagaggaagatgaaaaaactgaaattacggttgacgcacctctggtataagctgctgatgaaacttgggctgaaaagtgatgaagtctattacataggcgggagtgaagccctgccgcctccattatctaaagatgaggagcaggttttgttaatgaagctcccaaacggcgatcaggcggcgcgcgccattctaattgaacgcaatttgcgtctggtcgtatatatcgcccgtaaatttgaaaatacgggaattaatatagaggatttaatcagcatcggtaccatcggtctaatcaaagctgtgaatacattcaatccagaaaagaaaatcaagcttgctacctatgcctcccggtgtatagaaaatgaaatcctgatgtatttaagaagaaataacaaaatccgttcagaggtttcctttgatgaaccgcttaatattgattgggacggcaatgagcttttgctttctgatgtgctcggcactgacgatgacatcatcactaaagacatagaagctaacgtcgataaaaagcttttgaaaaaagcgcttgaacagcttaatgagagagaaaagcaaatcatggagctgcggtttgggcttgtcggtgaagaagaaaaaacccaaaaggatgtagcggatatgatggggatttctcagtcttatatttcgcggcttgagaaaagaattataaaaagattgagaaaagagttcaacaaaatggtgtaaaaaaatttatggttagaaccccttgattttacagggatttcctgatttcgacagtttttcggtctgagtgcagtgcatatttttcccacccaaggagatacttaacgttgtacagcagctcctgtagggagggaaaaaagtgtcgagaaataaagtcgaaatctgcggggtggatacctccaaattaccagtactcaagaatgaagagatgagaaagctgtttagacagctgcaggatgaaggcgatgattcagcaagagaaaagcttgtaaacgggaacttgcgtcttgtcttaagtgtcattcaacgatttaataacagaggggagtatgttgatgacttatttcaagtcggctgcatcggactaatgaaatccattgataattttgacctaagccacaatgttaagttttcaacatacgctgtacctatgattatcggagagatccgcaggtatttacgcgataataacccgatccgtgtctcaagatcactccgggacatcgcttacaaggcgcttcaggtaagagagcggttaatcagtgagacaagcaaggagccgactgcagaagacatcgcaaaagttcttgaagtaccgcatgaggaaattgtatttgcgcttgatgccatccaggatccggtttctctatttgaaccgatctataacgacggcggagacccgatctatgtgatggaccaaatcagtgatgagcgtaatacagattcacaatggattgaagagctggctttaaaagagggcatgagaaggctgaacgatagggaaaaaatgattttgagaaagcgattcttccaagggaaaacccaaatggaagtcgccgaggaaatcggaatttcccaggcgcaggtgtccagacttgaaaaagcggctatcaaacaaatgaataaaaatattcatcaataatgaaaagcctttaaaacgatgttgttttaaaggcttttctattgattacggatggtttacgttttggaaaaagtaaggtatcctagttcgtacaaagttttatgaaaattaaaacaattataaaaggcaataaagaggaggaccacgatgattttgcagcttgacaatgtctcactaaaacggaatgggaaatggatactgagagatattcattggaaggtggaagaaaaggaaaattgggtgctttacggcctaaatggcgccgggaagacagcgctgttaaatatgctttgttcatattattttccaacatcaggcgagatgcaggtgcttggccatgaatttggcaaaacagagcttggggaaaagctcagacgtaaaattggcctcgtctcagcagctcttcagcaaaaattgtatccggcagattcagcctttgaaattgctttgagcggagcttacgcttcgattgggttatatgaaacgccaagtaaggaaaccagggaaaaagcgattggtttgttagaggacttgggagcaattgaatatgccgatcgccgctatgaaaccctttctcaaggggaaaaacaaagagcgttgattgctagagcactaatggccgatccggagttgctgatactggatgaaccagtcacagggctggattttattgcccgggaaaagttgttagatacgattacatacattgcaaacaaagaaaatgcaccatctatcctttatgtgactcatcatgctgaagaaattttacctgtctttgataaagcccttttattaaaacagggagaggtctttggatccggagaaataaaggaaatgcttactgatcaaatactttccgctttttttgatatgccaatccatgtattatggaatcaggatcggccgtttttaacaagagctgagccgataacgaatgcctgacaaacatatatagattcatcctaggggtgctttacgaagctgagagagactttgtctcaacccttttgacctgatctggatcatgccagcggagggaagcggtgaaaagcggagtacatcggactccgtttgtttttattaagccgtttcatcacatttgaaacggcttttttgattttaaagaataggagcggatttacattggatcaacaaatagactctttgcaaaaaaaagtggaagaacaaaaggaggagcttattcagcttgctaaaacactgatttcttatcaaacacccgctccgcctgcaagaaatacagagggcattcagtcatggattgcgggatttttaaatgaattgggattctcgatcgacaaatgggatgtgtaccctggagatcccaatgttgtcggcaagctaaagggaacagattcagcagattattatagcctgattatcaatggtcatgtagatgtggcagaggtaaaagaggatgaagaatggaagcacgatccgtttcatcccattgaaaaaaacggtctcttaatcgggcgaggcgcttccgatatgaagggcggaatggcttgtgtgctgtttgctgtcaaattatttcgtgaagccggcattgagcttccaggtgatctgattctgcaatcggttattggggaggaagttggagaggccggcacacttgaatgctgcaagaggggctaccacgctgattttgcaattgtcgcggatacgagcgatatgcatattcaaggccaaggcggtgtcattacaggctggatcgaaatcaaaagcagtcaaacatttcatgatggaacgagacggaatatgattcatgcaggcggaggaacattcggagcaagcgcaattgaaaaaatggcaaaaatcattgcggggctcggtgaacttgagcgccactggtctattatgaaaagttatcccggttttaaacccggcacaaatacgattaacccggcagttatagaaggcggcagacatgcggcttttatagcggacggatgccggctgtggatcacagtccatttttatccgaatgaaacccatgaccaagtggcagcggaaatagaagattacgtcaatcggctgagtgacagtgatatttggcttagggaaaaccgccctgtattcaagtggggaggctcatctatgatagaagacagaggagaaatttttccggcattggaagttgaccctggccacccaggcgtcttagcgctaactgcctctcatgagaaagtgaaacgggagtgtccaattattgacgtttctcaatcagttacagatggcggatggctgtatgatgccggtattccatgcgtaatatacggtcctggagatctgcacaatgcacactctgtgaacgagaaggtatcgattgagcagctagtagagtatacaaaaattatactcgattttatcatcagctggtgcagccggaaaaaagaacaatgacatgaaaatttcttcttgctgacaaggttcagcctgcccgttcatatacttgaacaaaaggacggaaaaaggacgtgatggaatgatcagcatttcagaatttcaggtaaaggatgtcgtcaatgtctcaaacggaaaaaagctggggagtattggtgatattgatatcaatgtgactactggaaaaattcaggcgatcatactcggaggaaatgggaaagttctcggattttttggaaaagaagaggaattggtcattccatggcgaaatatagtaaaaatcggggaagatgtaatcttagtccgattaagtgaaccgcatgcataaacctgcttctctgccgcagattggcaaatgccggaagtctcgattcttccggcacatttcatttagaaatatgcaaatcggcgctcaacgaatgcagtaagatgtggtaaaataagtgggaaattccgcttttttaaatgtttgtcgaaaggttggatcatcatgaatacatatcacccattcagtcttaccacaccctcgacactcatgatacaagactgggctcaaacgaatcaaaacaacaaagaggtcattgccggatttacgacaaaaaacggcggtgtcagccaaaagccttttgaatcgttaaatacaggattgcacgttcatgacaaagatgcagatgtagttaaaaatcgtgaatatattgccgatatgtttaatactgatttgcagtcttgggtattcgctgatcagacacatgataatcgcgttcagaaagtgacgcagagggataggggaaaaggcacccgtgagtatcacacggctctaaaagcaacggacgggctctatacaaatgaaaaaaatgtatttttagcattatgctttgctgattgtgtgcctcttttcttttatgatccggttaagtcgcttgtcggagtcgcccatgccgggtggaaaggcaccgtcaaacagattggcagagaaatggtgaagcaatggactgagaaggaaggttcaaatccctcagatatttacgctgttattggcccgtctatcagcggagcatgctatacggtagacgaccgcgtcatggatgctgttcgtgcattgccggtttcagcagaccttgccgccaatcagacggcaaaggcacaatatcagcttgatctgaaagagctgaaccgtcttatactgatggacagcggtttggcaagtgaacaaatttctgtcagcggtttatgcacggaaagcgagccgtctcttttctattctcatcgccgcgatcaggggaaaactggacggatgatgtcctttatcggaatgaaggaggcataaaagatcttgcgtgttgttgataatttacgacatataaacgaacgaataaacgaagcatgtaacagatcgggccgcagctccgatgaagttacggttattgcagtcacaaaatatgtatcacctgaaagagcacaggaggcagtagatgctggcatcacctgcctcggagagaatcgggatgcggaactgctccgcaaacaggaattgatgaaagggaatccggaatggcattttatcggcagtttgcaatcaagaaaagcaaaatctgtcgtcaatgcggtttcctatatccattccctagaccggctctcattagcgaaagaaattgaaaaacgggctgaaggtactgtacgatgctttgtgcaggtcaatacctctcttgagccttctaaacacggcatgaaaaaagaagaagtcattccattcatacaggagctttccggtttcgaacatatccttgttgccggactgatgacaatggctccgctgactgatgatcaagatcagatcagaagctgtttcaggtcgctgagagaactccgtgaccaggttcagaagctgaaccagccgaacgctccgtgtactgaactgtcgatgggcatgtcaaatgattttgaaattgcaattgaagaaggagctacttatattagaatcggctcatcgttagtcggaaatgaaacaggggtgtacagcaatgagtatgaaaaataaactgaaaaactttttctcaatggaagatgaagaatacgaatatgaatatattgagacagagcgggaatctcatgaggagcatgagcaaaaagaaaagccggcttatacggggaataaaccttcgggcaaacagaatgtagtgagcttgcaaagtgttcagaaatcctctaaagtggtgttgagtgagccgcgcgtttatgcggaggcgcaggaaatagccgaccatttgaagaaccggcgggcagttgtcgtcaatcttcagcggatacagcatgaccaggcgaagcggattgttgactttttaagcggaaccgtttatgccatcggcggcgatattcaaagaatcggctcagatattttcctctgcacgcctgacaacgtagatgtatcaggcacaatttctgagctcatatctgaagacgaacatcagaggtggtaaagcgagatgatcctttatcaagttttttcggttttaagcttattaatcacaatatactcatttgccctgatcatatatatttttatgtcatgggtgccgagtacgagggaaacagcagtcgggcgttttttggcttcgatttgtgaaccatatctcgaaccattcagaaaaatcatccctccgattgcaatgctggatatttcaccaatcgtagcaatacttgtgcttcggtttgcgacaaccggcttgtggggactttatcgcatgattgcgttttaatgtgacagtttgatagtggcttggcagcagccaagcctctttacatagaagggaaagacgatgagcgatatatatcagcacttcagaaaagacgagcgggcctttattgatcaggcgctcgaatggaaaagaattgtccaggagcagtaccggatgaagctgaccgactttttagacccccgagagcaggtcatcctctctgctgttacgggacaggcagatgtcgggcttgctttttccggcggttatgacagagcggagcggaaacgggcgattctgtttccagagtacattactccggaagaatcagattttgaactgcaggcgtttaacgtccgttatgctgacaagtttgtctcagtagatcatcgttctctgcttggtgcattaatgggcataggattaaagcggcaaaaattcggtgacatcgtgttttctgagacagcagtgcaattgattgtctcagccgataccgctgattttgtggctgcacagctgatccaagcaggcaaagcggcggtcagcctagagaaaattgacttgtcagaccttaacattccagcagttgatgtcgaaataagagatgacacggtttcttctttaaggcttgacgccgtctgcgcctctatgagcaggcaatcccgccagaaatcacagacgcttgtgaaaaacggccttgtgaaagtgaactggaaggtggttgaagatccttcatacatagtcgcggaaggggacatgctgtcaatcagaggttttggccggtgcagcttaacaaaaatcgaaggaaaaaccaaaaaagacaaatggagagttacgtttgaacgacaaaaatagtcggtttttcagtttttttctccatctgtgcgaaatttgttttataatgtgaactagataaccgtactgaaatgtaaaaatggaggtggcatcatgccattaacgccaaatgatattcacaacaagacgtttacaaaaagttttcgcggatatgatgaagatgaagtaaatgaattcctagcccaagtcagaaaagattacgaaattgttctccgcaagaaaactgagcttgaagcgaaagtcaatgagcttgatgaaagaatcggacactttgccaatattgaggagacattgaataaatcaattttagttgctcaagaagcggctgaagacgtaaaacgcaattctcaaaaagaagcaaagctgatcgttcgggaagcggagaaaaacgctgatcgcattatcaacgaatcgttatcaaaatcaagaaaaattgcaatggaaattgaagagctgaaaaaacagtctaaagtgttcagaacacgtttccaaatgctgattgaagctcagcttgatcttctgaaaaatgacgattgggatcatctccttgagtatgaagtcgacgctgtatttgaggaaaaggaataaattctctgattatcttgacattttcttagcttgtcgaatataatacgttcataaattcagatgaaaaaacggttgaaagggacagtcatgtttccttcaggccttcatagcgacccggagatggtgagagtccgggatggccggaatcatgtagatcagccctttagtttccttgctgaactcacagtaggttaggacgttcatcacgttacgatgctcaagaggaaaaagtgtatgcttgctttttctaaaagggtggtaccgcgagataagctttctcgtcccttatgggatgagagggctttttttattttctgaaaaaatgcagtggaggaatgaaaatggattttaaagacacgctcttaatgccgaaaacagatttcccgatgcgtggaaatttgccaaaccgtgagcctgacattcaaaaaaaatgggaggaagaagatatctaccgtcttgttcaggaacggacgaaagaccgcccgaaatttgttttacatgacggacctccgtatgcaaacggcgacatccatatgggccatgcacttaacaagattttgaaagacttcattgtccgctataaatcaatgagcggctacaacgcaccgtatgtgccgggctgggatacacacggattgccaattgaaacagctctgacaaaaaacaaaaaggtcaaccgcaaagaaatgtcagtagcggaattccgcaaactgtgcgaagagtacgcttggaagcaaatcgagggacagcgtgagcaattcaaacgtcttggtgtccgcggtgactgggaaaacccatatgtgacattaaaaccggaatacgaagcgcagcaaatccgcgtatttggtgaaatggcaaaacgaggctacatttacaaaggccttaaaccggttaactggtcaccttcaagtgagtctgctctggctgaagccgagatcgaatatcaagacaaacgttcagcatctatttacgtcgcttttggtgtaaaagacggaaaaggcgttcttgaaaatggcgagcgcatcattatttggacaacaacgccttggacaattccggcgaacctcggaatttcagtgcaccctgatcttgagtacagcgtgattgcagtaggtgaagaccgctttgtcgtagcaagtgccttagtcgaaaatgttgcattggcatgcggatttgatcagtatgaagtgacaagaacggtcaaaggaaaagaccttgagaacattatcgctgaacacccgctatatggcagagactctctcgttatgcttggtgaacacgtaacaactgatgccggaacaggctgtgttcatacagcgcctggacatggggaagatgactttatcatcggccaaaaatacggtttagatgtgctttgcccggtcgatgaaaaaggtgtaatgacaagcgaagcccctggctttgaaggcatgttctatgatgatgcaaacaaagcgatcacacagcagcttgatgaaaaaggcgcacttgtgaagcttgaattcattactcactcttatccgcatgattggagaacaaaaaaaccaaccattttcagagcgacagcgcaatggtttgcgtctattaaagatttcagatcagacctgctggatgccattaaagaaaccaaatgggttcctgaatggggcgagcagcgtttgcacaacatggttcgggaccgcggagactggtgtatttccagacagcgtgcgtggggtgtgccgattccggtattttacgctgaaaacggagaaccgattattacagatgaaaccattgaacatgtttctgaattgttcagacagcacggatcaaacatttggtttgaaaaagaagcaaaggatcttcttccggaaggctttacgcatcctggcagcccgaacggcacatttacaaaagaacaggatatcatggatgtttggtttgattcaggctcttcacatcaagcagtgcttgaagaacgtgatgacctcgttcgcccggctgatttatacttagagggatctgaccaatatcgcggctggtttaactcttctctttctacagcagtagccgtaacagggaaagcgccgtataaaggtgtgctcagccatgggttcgcactggatggagaaggacgcaagatgagtaaatcaatcggtaacgttgttgttccggctaaagttatgaaacagcttggtgccgacatcttaagattatgggtatcttcagtggattatcaggcggacgttcgcgtgtctgacgccattctgaagcaggttgcggaagtatatcgtaaaatccgcaacacgttccgtttccttcacggcaaccttttcgattttgatccaaaaacaaatgcggtggctgtcgaagatcttcgcgaagtggatcagtatatgctgattaagctgaacaagctgattgataaagtgaaaaaagcgtatgatgagtacgaatttgcggttgtgtatcacagcattcataatttctgcacaatcgaattgagctcattctaccttgattttgcaaaagatattgtctacatcgagcatgcggatcatccggatagacgcagcatgcagacagtattctacgaaacgcttcttgcattagtgaagctttcagcgcctatccttccacatacggcagacgaattgtggtctcatttaacatttgttgaagagcagagcgttcagctgaccgatatgccggaaacaatcgcggttccaaacagtgaagcgactgaagaaaaatttgaccgctttatggctcttcgtgatgacgtgttaaaagcattagaaactgcgcgaaatgaaaaaattatcggtaaatctttggaagcaaacctgaaattgtatccaaacaaagaaaacaaggagctcttggcttccataaaagaaaacctttctcagctgtttattgtgtctgaactgacaatcagcgaagaaaatgaagcgccgaacgatgcgcaaagctttgcgacaggtaaaatcgctgtcgagaaagctgaaggcgaaatgtgtgagagatctcgtgtgatttcaaaagatgtaggggcaaatccgaaatatcctacactttcattacgcaacgctgaaatcgttgaaaaatactatcaaaaataatgcaaaagagcccggcttaaaagccgggctttttttgtgccaagagtgacatcctttagaacgacaggaaaaatcttatgggctttagatcatcattcgcaggcaacaataaagatactacgttaagagcaggagttgtgaagaatgaatgatcaactgaccgcaatttatacggaacttcttctgatgaaagaagaattacagtccagattatttgagtattcttgctttcaggtttctacaagcccgcaagcagcaatcaatcaaaaacaaaaagcaactctgatctatcatattaaagaagaacttcaagacgttctccttgcattgtccaaaatcgaaaacggcacattcggatactgtgaagaaaccggggctcccattcctcttgcaaagctggcagtgctgccgacggcccgaacagcaaacgattttctttattctgtccaatttgagaaaaaaacgcttccgatatggaaatcaacggatatcgaatatggtcaggcactgtatgaataacagtgtctggccggttattatgcctgatatttctttactccagtgctttttattgataaaatgcataatggattaaagtaaccgtaaactggaggaacgtttgtgctgtattatatgattgcactacttattattgcagccgatcaattgacaaaatggctagttgttaagaacatggaacttggccaaagcattccgatcattgatcaggtattctatatcacctcccatcgcaatacgggtgctgcatgggggatattagcgggtcagatgtggtttttctacctcataacaaccgctgttattattggtattgtttattacatacagcgttatacaaaaggacaaaggcttcttggtgttgccctcggacttatgcttggcggtgccatcggcaactttatcgatcgggctgtcagacaggaagttgtggattttatccatgttattattgtcaattacaattacccgatatttaacatcgcggactcttcactatgtgtcggcgtaatgcttttatttatacaaatgctgttggacagcgggaaaaagaaaaaggagcaatagcatgaatcaaattgatataaccgcttcagaagaacaaaaaagtgagcggattgataaatttttggcatcgactgagaatgattggtcaagaacccaggttcagcaatgggtaaaagacggacaggttatcgtgaacggaagcgcggtgaaagcgaattataaaattcagccgggtgatcaggtgaccgtcactgtacctgaaccggaagcgctcgacgtcctggcagagcctatggatctggatatttattatgaggaccaggatgtgctggtcgtcaacaaacctcgcggaatggttgttcacccagcacccgggcatcttacgggcacacttgtaaacggccttatggctcattgcacagacctttccggaataaatggcgtgatgcgtccgggtattgttcacagaatcgataaggacacgtccggtttattaatggtggcgaaaaatgatatggcgcacgagtcacttgtaaaccaattggtcaacaaaacggtcacgcggaaatatacggcagttgtccacgggcttatttctcacgatgatggcacaattgacgcgccgatcggacgagataagaaagaccgtcaaagcatgactgtgacacgtgatggcaaaaacgctgtcactcattttcatgtactagagcgttttcaggattttacgttagtggaatgccagcttgaaacagggagaacccatcaaattcgtgttcatatgaaatatatcggattcccattagcaggcgatccgaaatacggcccaagaaaaacaatcgactttaatggccaagcgcttcacgcgggagttttaggttttgaccatccacgaacaggagaatatgtcgaatttgaagcgccgcttcccgaggatatggcagaattaatcgaaaaccttagaaaaaacggttgacagagggtttcttttctgaaataataaacgaagctgaatagattctttaaaacagtccagagaggctgagaaggataacggatagacgggatgcgtgtacaggcgcgcaccttgtcctaaaacccctctatgctctggcaggaggggttttttcttctatatgaactgtgaggtgtcacacattgaatcaaaaagctgtcattctcgacgaacaggcaatcagacgggcgctgaccaggattgctcacgaaatgatcgaacgcaataaaggaatgaataactgcattcttgtcggcattaagacaagagggatttacctggcaaaacgccttgcggaacgcattgaacagattgagggaaatcctgttacagtcggtgaaattgatattactctttacagagacgatctttctaaaaaaacgagcaacgatgaaccgcttgtaaaaggtgcagatattccggtagatattacagatcaaaaagtcattctcgttgatgatgttctgtataccggaagaacagtcagagcaggaatggatgcgcttgttgatgtaggcagaccttcctccattcagcttgcagtgcttgtggacagaggacaccgggagctgccgatccgagcggattatatcgggaaaaacatcccgacatcaaagtctgaaaaggttatggttcagcttgatgaggtagaccaaaacgatctcgtcgccatttatgaaaacgaataatagatcacctttttaagggcaatccagagaggttgcaaagaggtgcacaacaaaggcccaaaaagtattcggcaggtctttgtatgcctctttgcgtaaaaaagcaaagaggtttttttatacagtcattgagtcatcctaaaatgaaagtcaacaatcagggggaaatcatcatgagtaagaaaaaagtaaatttaggggtcagggatgtcccgacacctttctcttgggtttcattcagccttcagcatttgtttgccatgtttggctcaaccattttggttccgaagctcgtcggaatgagtcctgctgtggcgttggtgacaagcggcatcggaacactggcgtaccttcttattacgaaagggcaaattccggcgtatctcggttcatccttcgcctttatttctccgatcattctggtaaaagcgaccggcgggccgggagcggcaatggttggagcgtttcttgcagggctggtgtacgggctgattgccttattgatcaggcagcttggaacaggatggctgatgaagattctcccgcctgtagtcgtagggcctgttattatcgtcatcgggctgggactggcaagcactgcggtaaacatggcgatgtatgctgatccaaacgcgagtgagttggtctacagcttaaagcactttagtgtcgcaggagttacgctggcaatcacgattatttgtgcgattttcttacgaggatttttaagcctgattccggttctgatcggaatcatcggcggatacctgttcgcccttactcaagggattgtcaacttccagccggtgcttgatgcgaaatggtttgcagtgcctgaatttatcattccgttcaaagattattcaccgtcagttacactcggcatcgcagccgcaatggttcctgtcgcatttgtcaccatgtcagagcatatcggccaccaaatggtgctgagcaaggttgtcggacaagatttcattaaaaagccaggtcttcatcgctctattatgggtgacagtgtggcgacaatcctcgcttccctgatcggcggtccgccgacaacgacttacggagaaaacattggcgtgctggccatcacaagagtattcagcgtctttgtcatcggaggagcggcagtgattgcctgttgcttcggctttatcggcaaaatttcagcgctgatcagttcagtgccgtcagcggtcatgggaggcgtctccttcctgctgttcggaatcattgcttcaagcggcctgagaatgctgattgacaacaaaattgattatgaaaacaacagaaacctcattattacatcagttatccttgtcatcggtgtaggaggcgcttttatccaagtatctcaaggcggattccaagtgtcaggaatggcgcttgccgcaattgtcggtgtcatcttaaacctgattcttccgcaggcgaaggaagagcagacagacacatctgaacaacatcatatctaaaaccttttaatgaaagtccagagaggcttggaagggttatgaagagaaggaagcttcaatgctgccctctatttaaccataccccgagtctatcttagaccggggtttttttcagccttaagttgaaaagagaggggaaagaacatgaagcatttaacgacgatgagtgaactcggcactgaggaaatcaaagatttgcttcaaacagcacaagaccttaaaagcggaaaaacagacaatcagcttacaggaaagtttgccgcaaacctgtttttcgaaccgagcacgagaacgcggttcagctttgaggtcgcagaaaaaaagctgggcatgaatgtgcttaaccttgatggaacaagcacaagcgtgcaaaaaggcgaaaccttatatgacacgatccggacgctcgaatcaatcggtgtggacgtctgcgtcatcaggcacagtgaggatgagtattatgaagagcttgtcagccaggtgaacattccgattctgaatgcgggagacgggtgcggccagcatccaacacaatcactgcttgatttaatgacgatttatgaagagttcaatacgttcaaagggcttaccgtctccattcacggcgacatcaagcatagcagagtggcaaggtcaaatgcggaagtgttgacaagattaggtgcccgggtcctattttccggcccttcggaatggcaggatgaagaaaatacattcggcacgtatgtctcaatagatgaagcagttgagtcttccgatgtcgtcatgctgctgcgcattcaaaatgaacgacatcagtccgctgtcagccaggaaggctatttaaacaaatacggcttgaccgtagaacgggctgagcgtatgaagcggcatgcgatcatcatgcatcctgctccggtaaacagaggagtggagattgatgacagcttagtagaaagcgaaaaatcaagaatcttcaagcaaatgcaaaatggcgtatttatcagaatggcagtgatacagcgtgccttacaaaccaatgtgaaaagaggagaagcagcatatgtcatatctcattaaaaacggctggatactaaacgaaaatggtgaaaaaacagaagcggatatccgagtgactggagaaaccatcaccgcaatcggcaagcttgatgcaacggataatgaaacggtaattgatgcaaaaggtttgctcgtttcacctgggtttgttgatctccacgtgcatttcagagagccgggtggagagaaaaaagaaactattgaaaccggggccaaagcggcggcacgcggcggctacactacagtagcagcaatgccgaatacgcggccggttcctgatacaaaggagcagatggaatgggtgcaaaacagaattaaagaaacatcatgcgtcagagttcttccatatgcatccattacgatcagacaaatcggcgatgaaatgacaaactttgaagcgttaaaagaagccgggtcatttgcttttacagatgacggcgttggtatacagacagcaggaatgatgtatgaagcgatgaaacgggcagccgcaattgacaaagcgattgttgcacattgcgaggacaactccttaatttacggaggaagcgtacatgaggggacattctccaaagcgaacgggctcaacggcataccttctgtgtgtgaatcggttcatattgcccgcgatgtgctgctggctgaggcggcaaactgccattatcatgtatgccatatcagcacgaaagaatctgtcagggttgtacgcgatgcgaaaaaagcgggaatcagagtgacagcagaagtgtcgccgcatcatttgctgctttgtgatgaggacatcccggggctggatacaaactataaaatgaatcctccgctccgcagtgcagaagacagagctgctttaattgaaggtcttttagacggaacaattgattttatcgcaacagaccatgcaccgcatacggaagaagagaaaaacacagaaatgaaactggcgccattcggaattgtcggcttagaaacagcatttccgcttctttacacacactttgtcaaaaatggcagctggtcgctaaagcagctgattgactacatgacaatcaagccatgcgaagcgttcggtctcccatatggaacattacaaacggggcaagctgcggacattacgttaatcgatttagaaaaagaagcagttatagacaaagacacgtttttatcaaaaggaaaaaatacaccattcaacggcatcagctgcaccggctggccggtcgctacaattgcggcagggaagcttgcttatgaagaggggagacttgtcaaatgaagagacgattagtactggaaaacggagcggtattcgagggggaagccttcggaagcttagaacacaacatgggagaagtcgtttttaatactgggatgacaggctatcaggaaattttatctgacccttcttactgcggacagatcgtaacattaacatacccgcttatcggaaattacggcattaaccgtgatgattttgaatctattaccccttttgtgaaagggctgatcatcaaagaattatgtgagctgccttccaactggcgttcagcatacaccttagacgagtatttaaaaatgaaaaacattcccggactccaggggattgatacaaggaagctgacaagaatgatccgcacggcaggcgcgctaaaaggaacattcgcttcatctgatgaagatatcgaagcagttctgaaaagactgaacgaaacggaattgccaagaaatcaagtatcccaagtatcagcaaaaacagcatatccgagcccgggaagaggcaaacgcatcgtcttggttgacttcggcatgaaacacggaattctaagagagctgaacaaacggaaatgtgacgtcatcgttgtgccttacaacattacagcggaagaggtgcttcagctgaaaccggacggtatcatgctttctaacggacctggagacccgaaggatgtgcctgaagcgattgaaatgattaaaggtgttcttggaaaagtgccattattcggaatatgtcttggccaccaattattcgcgctggcgtgcggggcgaatactgaaaaaatgaaattcggacacaggggctcaaaccacccggtaaaagagctggctacaggaaaagttgccttaacatctcaaaaccatggatacacagtttcgtctatcagtaaaacagaactggaagtgacgcatatcgcaattaacgacgatacgattgaagggctgaagcataaaacattgccggcatttacggttcaatatcatcccgaagcctcacctggtcctgaggatgccaaccacctatttgacagattcatcgaaatgatcgaaacaacagagaaagaaggggaagcggtatgccaaaacgcgtagacattaacaaaattttagtaatcggatctggaccgatcatcatcggccaagcagcagaatttgactatgcgggaacacaagcctgtcttgctttgaaagaagaaggttatgaagtcatccttgtcaactcaaaccctgccacgatcatgacagatacagaaatggctgaccgggtttatatcgaaccgctcacacctgaattcttgacaagaatcatcagaaaagagcgaccagatgccattcttcctacactcggaggccaaaccggtttgaatcttgcggttgagctttctgaaagaggtgttctggcagaatgcggcgtcgaagtgcttggcacaaaactgtctgcgattcagcaagctgaagaccgtgacttgttcagaacattaatgaatgaactgaatgaaccggtgcctgaaagtgagattattcactccctcgaagaagcggaaaaattcgtcagtcacattggattccctgtcattgtccgcccggcatatacattaggcggaacaggcggaggcatctgctcgaatgagacagagttaaaagaaatcgttgagaacggcttgaaattaagcccggtacaccaatgtctgcttgaaaaaagcatcgccggctataaagaaatcgagtatgaagtcatgagagacagccaggatcacgccattgtcgtttgtaacatggaaaacattgatccagttggaatccatactggagacagtattgttgtcgcgccgagccaaacgctcagtgatcgcgaatatcagctcttgcggaatgtatcgttaaaactgattcgcgcgcttggaatcgaaggcggatgtaacgtacagctcgctttagatccagacagcttccaatattacattattgaagtaaatccgcgtgtcagccgttcatctgcccttgcatcaaaagcaacggggtacccgattgcaaagctcgctgctaaaattgcagtcggactttcattagatgaaatgatgaacccggtgacaggaaaaacatatgcagcatttgaacctgctcttgactatgtcgtatccaaaattccgcgctggccgtttgataagtttgaatcagcaaacagaaagcttggcacgcaaatgaaagcgacaggtgaggtcatggcgatcggccgcacgcttgaagagtcattgctgaaggcagtgcgatcactggaagcggatgtgtatcatcttgaattgaaggatgccgctgacatttcagatgagcttcttgaaaagcgaattaaaaaggccggtgatgaacgcttattctacttagctgaagcgtacagaagaggctacacggtagaagacctccatgaattttccgctatcgatgttttcttcttgcataagctgttcggaatcgtacagtttgaaaaagaattgaaggcgaatgcgggcgatacagatgtgctgagacgggcaaaagaactcggcttctctgatcagtacatcagccgcgagtggaaaatgaaagaatctgagctttacagcttgagaaaacaagcggggattgcgccggtattcaaaatggtagatacatgtgcggcggaatttgagtcagaaacgccatacttctatagcacatatgaagaagaaaatgaatctgtcgttacagataagaaaagtgtgatggtgcttggttcgggtccgattcgaatcggtcagggtgtcgagttcgactatgcgacggttcactctgtatgggcaattaaacaagcaggctatgaagccattattgtcaataacaacccggaaaccgtttcaacagacttcagcatctcagacaagctgtattttgaaccgcttacgattgaagatgttatgcacatcattgacctcgaacagccaatgggcgttgtcgtacaatttggcggacagactgcgattaaccttgctgacgagctttctgcacgcggagtgaaaatccttggaacttcattagaagatttagaccgtgcagaagaccgggataaatttgaacaagcgcttggagaacttggtgttcctcagccgcttggcaaaacagcgacatcagttgatcaggcggtaagcatcgcgagtgatatcggttatccggtactggtgcgtccttcctatgtacttggcggccgggcgatggagattgtgtatcatgaagaggagctgcttcattacatgaaaaacgcagttaaaatcaatccgcagcaccctgtattaattgacagatacttgacaggaaaagaaattgaagtcgatgcagtatccgacggtgaaacagtcgtcattccgggaattatggagcacattgaacgtgcgggcgttcactccggagactcaatcgctgtttatccgcctcagtctctcacagaggacattaagaaaaaaattgaacaatacacgatcgcattggctaaagggctgaatattgtcggtttgctcaatattcaattcgtcttgtcgcaaggtgaggtgtacgtgctagaagtgaatccgagatcaagcagaaccgtaccgtttttaagcaaaattacgggtatcccaatggcgaatctcgcaacaaaaatcattcttggtcaaaagctggctgcgtttggctatacagagggccttcagcctgaacagcaaggtgtatttgtaaaagcgccggtcttctcctttgccaagctgagaagagtggacattacgttagggcctgaaatgaaatcaacaggtgaagtcatggggaaagattcgacacttgaaaaggcgctctacaaagccttgattgcttcaggtattcaaatcccgaactacggttccgtgctcttaacagtagctgataaggacaaagaagaagggcttgcgattgctaagcggttccacgcgatcggctacaacattttagcgacggaaggaacggcaggctacctgaaagaagcttccattccagcgaaggtcgtcggaaaaatcggccaggatggcccgaacttgcttgatgtcatcagaaacggtgaagcgcagtttgtcatcaatacgctgacaaaaggaaagcagccggcaagagacggttttagaatcagacgtgaatcagtagaaaatggtgttgcctgcctaacatctttagatacggcagaggcgatattacgagtgctggaaagcatgacattccgtgctgatcaaatgccggcagtcaacacaaatcaggaggcggcagtcactatatgaaaaaagcgtatttgacagtatgttctaaccagcaaattgcagaccgggtgtatcaaatggttctgaaaggggagcttgtccaagggtttacaaccccgggacagttccttcatcttaaagtgagcgaagcggttacgcctcttttgagaaggccgatcagcatcgcagatgtcaactttgaaaaaaatgaagtcaccatcatttatcgggtagatggggaagggacaagactcttgtcactgaagcagcagggagaacttgtggatgtcctcgggcctttgggaaatggctttcctgttaatgaagttcaacccggaaagacggctttgctggtaggaggcggagtaggtgtgccgcctctccaagagctgtcgaaacgcttgaatgaaaaaggggttaatgtcatccacgttttaggattccaatcggcaaaggatgttttttacgaggaagaatgcaggcagtacggagacacgtatgtggcaacagctgacggaagctacggggaaaccggatttgtcacagatgtgattaaacggaaaaatctagagtttgatatcctcctcagctgcgggccgacaccgatgctcaaggcgttaaaacaggaatatgcccataaagaagtatatctgtccatggaggaacgaatgggctgcggaatcggcgcatgcttcgcgtgtgtgtgccatacaaacgaaagtgagacatcctatgtaaaagtatgtctcgacgggcctgtatttaaagctcaggaggtggcgctgtaatgctagaggtgaaattgccgggacttgatttgaaaaatccaatcattcctgcatcaggctgcttcgggtttggaaaagagttttcacgtttttatgatttgtcttgtcttggagctatcatgattaaggctacgacaaaggagccgcgcttcgggaatccgacgccgcgggtagctgagactggtgctggaatgctcaatgcgatcggtctccaaaatccggggctggatagcgtgttgcatcatgagctgccgtggcttgagcagtttgatacgccgatcattgccaatgtcgcaggttctcaagtcgaggattatgttgaagtcgcagagcatatcagcaaagcgcctaatgttcatgctcttgaattgaatatttcctgcccgaatgtgaaaacaggcggaatcgcttttggcacgaatcctgaaatggctgccgatttgacaaaagcggtgaaagaggtttcggatgtacccgtttatgtgaagctttcccgaacgtggctaatatcacagaaattgccttagcgatcgaggaagcgggagcggacggtcttacgatgatcaacacactaatcggcatgagactcgatttaaaaaccggcaaaccgatattagcgaataaaacagggggactttcaggccctgctgtgaagccggttgccattcgcatggtgtatgaagtcagccaggcggtcaacatcccgattatcggaatgggaggcgtgcaaacggctgaagatgccctggaatttcttctcgcgggagcaagcgcagtcgctgtcggaacagcaaactttgtgaatccttttgcatgtccagagattattgaacagctcccatctgttttgctccaatacggctatcaatcaattgaagaatgcatcggaaggagctggaatcatgaaaaacaacctgcccatcatcgcgcttgattttgcgtcagctgaagaaacacttgcgttcttagcgccttttcagcaagaaccgttatttgtaaaggttgggatggagcttttttatcaagaagggccatctatcgtgaaacaactaaaagaaagaaactgcgagctatttttagatctaaagcttcatgacatcccgactactgtaaacaaagcgatgaagcgccttgccagtcttggagtagacctcgtcaatgttcatgctgccgggggcaaaaaaatgatgcaggcagctctcgaaggcttagaagaaggtacgccggctggaaaaaaacgtccgttacttatcgcggtaacccagctgacaagcacatctgaacaaattatgaaagatgaactgctgatcgaaaagtctctgattgatacggttgtgcactacagcaaacaggcggaagaaagcggactggatggagtggtctgctctgttcatgaagcaaaagccatttaccaagcggtgtcgccttcatttctgactgtcactccggggatcagaatgtcagaggacgctgcgaatgaccaagtccgcgtagcgacgcctgccattgcaagagagaaaggttcatcagcgattgtagtaggacgctcgattacaaaagcggaagacccggtaaaagcctataaggctgtcagacttgaatgggagggaatcaaatcttgaaacaaatcatcgcaaaacatctattagacatccaagctgtatttttacgcccgaacgagccgttcacatgggcaagcggcattttatcaccgatctactgtgacaaccgccttacgctatctttcccagaggtcagaaacgatgttgcttcaggtatcagcaagcttgtcaaagagcattttcctgaagctgaaatgattgcgggaacagcaactgctggtattcctcatgctgctcttgcggctgaccgtttgaatcttccgatgtgttatgtgaggagcaagccgaaggcgcacggaaaaggcaatcagattgagggagctgtgcaagaagggcaaaaaacagttgtcattgaagacttaatttccacaggaggcagtgtgcttgaagcttgtgcagctttacaagcggccggctgtgaagtgcttggtgtcgtctcaatctttacgtacggacttcctaaagcggaggaagccttcgcaaaggcagaactgccatactactcattaactgattatgatacgctcacagaggtcgcgcttgaaaacggaaatattcattcagatgatctaaaaaagctgcaaacatggaaacaaaatcccgagtcaaaagattggtttaaaaaataaaaaataaattcaaatgatgtaaagaggcttcaaagccttgatgtacttgaaaacaggctgtgaggcctgtttttttattaatcctataaaaaaagtcgggttgacttatgttagaattgtgctaaaatttactacaaatctaaaaacttatcaagagcggctgagggactggacctatgaagcccggcaacctgcatagtttgtaaggtgctacttccagcaaaatgaattccattttgaaagataagggctacatgctgttcctgtctttctttccgccggattgaaagttttttattttaagaggtaaaaaggctatctgtatatcagcagccgcgaatcacattacatgggaaaagacaaccggcagaaagctactgtttgtttgtctccgaaaggaggaaagaagaaatgttaacgtatgataattgggaagaaccaacgattacatttccggaagacgatccttataaaggagcgctgtcagttttaaaatgggcatacggccattacggcgatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagacctcacccttgaggaacaagccgaagaacatggtgacaaactatgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatacacatcccggaatgaactggactacaatccgcttcatgaccaaggatatccaagtattggatgtgcgccttgcactgctcccgcttttacagcagaggatttgcgctcaggcagatggaatggtatggcgaaaacagaatgcggactgcatgaataaggagctgcaaaatggaattagccgctattttatttagcttgtttttcgcgatgaatattggtgcaagcggcgctgcagcttcgatgggggttgcttacggctccggagccatcaaaaagaaaacctacgctttgatcctatgcgcagtcggtgtctttaccggggcggtcattggcggaggcgaggttgtaaaaacaatcagctccggcattattcctgagcagacgattacactgacgattgtttgcatcattattggagctgctgccctgtcgctctttactgctaacctgctcggtattcctttgtcgacaagtgaagtaacagtcggcgcggttgtcggcgtgggagtggcttataaagtattgtttgtgaacaatcttctgatcattgtgtcattttgggtttttgtcccgctgttcgctttcggcttcacctatttcgtatctaagctgtttcgttattttaagattgaagtaaaatcttctaaaaagcaaaaaatcctcggcattgttttgttagttgccggatttttcgaagcattctctgccggcatgaataacgtggcgaatgctgttggcccgttagtagctgccgatgtgcttgatgtcggaaaaggaaccttgtatggaggagcttttgttgctcttggcgcactgttattaggccggcgagtgctagaaacaaacgggaagaaaattacgagattctccaaaggggaaggcattctcttatccggtacaggagcgggactggtgatcatcagttctgtatttgggatgccggtgcccttggcgcaagtcacgtcatcgtctattatcggaataggcatggcaaaaaacggtccgaacgtgttccataaacaagttgttcaaacgatgctgaaggtatggatcgtatcgccgtttttatctttatcgatttcttatctgcttgtatccttgtttttaaaagcagattattattcgatctttatcatggtaagtgtgcttttagcggcgggcggtgccgtcagcctgacaaaggccattcgtaaagagagacgctcagtccacgaacaaggcgggggaatctgatcattaatctgagtaaatttataagttaactaggaggagatggatattatgagcttagcaccacacggaggaacattagtaaacagagtagatgaatcatatgatgtgagcggcattcaaaaagaaattgaacttgatttaatttctttcgcggatttggaattgatcggtatcggtgcatacagcccgattgaaggtttctttaatgaaaaagattacgtatctgttgtcgaaaacatgcgtctttcttccggcgttgtctggtctcttccaatcacgcttccggtcgatgcgcaaaaagcagcggaactgtcagttggtgaaacggtaaaattagcgtatgaaggagaaacatacggcgttatccaaatcgaagacctgtacgtgcctgacaaacaaaaagaagctgtcaatgtgtacaaaacagatgaacaggagcatcctggtgttaaaaagctgttcagccgcggcaatacatatgtcggcgggccgattacgttgattaaaaaagcttcaaaacagttccctgaatttacatttgaaccgtcagaaacgagacgccagtttgcggaaaatggctgggaaaccattgtcggtttccaaacaagaaaccctgttcacagagcgcatgaatacattcaaaaaacggctcttgaaacagtagacggcttgttcttgaatccgttagtaggtgaaacaaaatctgatgacattccagctgatgtacggatggaaagctaccaagtgcttcttgatcattactacccgaaagatcgcgttttccttggtgtctttttagcggcgatgcgttatgcaggcccgagagaagcaattttccacgcgcttgtcagaaagaactacggctgcacacatttcatcgtcggccgtgatcatgcaggtgtaggtgactattacggaacatacgaagcacaggagctgtttgacacatttaaacctgaagaactcgggataacgccgctgaaattcgagcacagcttcttctgtaaaaaatgcggaaatatgggaaccgcgaaaacatgccctcatggcagagagcatcacgtcattttatcaggcactaaggtaagaggcatgctgagagacggtgtgctgccgcctgctgaattcagtcgaaaagaagtcgtagaagtgttaatcaaagggatgaagaaaaaagaagaagtaggcgtatcttaaggaggactgacagtgacaaatcgcgatattgtatggcatgaagcctctatcacaaaagaagagtatcagcaaaaaaataagcataaaagctccattctctggctgacagggttaagcggctcaggcaaatcaaccattgccaacgccgctgcaagagaattgtttgagcaaggctaccaagtgattgtgctggacggggataatatccgtcacggcttaaataaggatcttggtttttctgatgaagaccgaaaagaaaacatccgccgaatcggagaggtggcaaagctttttgttcagcagggaaccattgtgattactgcttttatctctcctttccgcgaggacagacaacaggttcgcgagcttgtggaagcgggcgaatttaatgaagtctacattaaatgcgaccttgatatttgtgaacaaagagatccgaaagggctttacaaaaaagcaagaaacggcgagattccgttttttacaggaattgattctccttatgaagaaccggaagctccagagctcgttcttgattcaggacaacatgaccgtgaagcgtgtaaaaatcagctgatcgagtttgttaaacaaaaattgagctgaatatgatctgctgcgttcttctcagatgccggaatgcaagcgagaacatcatcacagcgaatgctctggaagaactcgaatagatcgggggaaatacgatggggaaagtatatattgtaggagcgggtcctggtgaccctgatctgctgacaattaaagcgctgaaagccattgaaaaagctgatgtcatcttatatgacagattagtaaataaagagattttacaatatgccaaagagcaagcagacctgatctactgcgggaagcttccagattttcatacgatgaagcaggaaaccatcaatcgatttcttgtgaagtatgcgcaaaaagggaaaatggttgtcagactgaaaggcggagacccttttgtgttcggcagaggaggggaagaagcggaatgcctctctgaaaatggaattccgtttgaaatcatccccggcattacgtctggaatcgcggcagccgcttatgccgggattcctgttactcatcgggaggcgggctctaacgtcgcttttgtaacgggtcattataaaaaagaagaagattttgaggaaaagtggaaagcgctggctacaggaattgatacacttgtcatctatatgggtatcaaaaacgtgcagcagatagaaagaaaactccttgaaaacggccgggacggttctacgccggcagcctttattcattggggaacaacggacaagcaaaaatctgttttttgtacagttgacaccctttcagaaacggtgataaaagaaaacattacaaatccgagtttaattgtcattggaaatgttgtaaattatcactataagctggaatggtttgaatctgaactgaaaaaacaagatttaagcgaggcgttgtaataatgaaacaagcaattttatatgtcggccacggcagccgggtcaaaaaagcgcagcaagaagccgcagcctttttggaaggatgcaaggcccacatctctgtgccagtacaagaaatcagctttttagagcttcaggagccgacaattgagacaggatttgaagcatgtgtgaagcaaggcgccactcatatcgcagtggtgcctctgcttcttttaacagctgcgcatgcaaaacatgatattccggaagaaattgcgcgtgttgcatctcgatatccgtcaatccgcatttcatacggaaagccgatcgggattgacgaagaagtagtcaaggctgtatatcaccgaatgaaagacataggtgttccatatgaaaatgccagagtggtactcatcggaaggggaagttcagatccagatgtcaaaagagacgtaaccggtattgctaatcttcttcaggaaatgattccagtcaaggaagtcattccgtgctttttgacagcatgcggccctaattacaaagaggttttttcagaacttaaaaaagatgacggcataacaacctttatcgttccatatttgctctttacgggaatgctgatgaatgaaatcgaacgagaggttcagaaattaaaagctcataatccgaacgtctacctctcttcctatatcggttttcatcctcatgtgaaaaacgcatttttgaaccgtgtgagagaaactgcggcaaatcctgaggggcaatttgattttgatggaggttcatatgcttccgctgcacattagcctggaaaagaagaaggttgtgattgcggggggcggcagcatcgctctcagaaggctgaaaacggtgatttctgagggagctgatataacgctcgtcagtccggatgttgaaccggaaatcaagcaaatggcagaagagcgacgtatcaaatgggaaaaacggacaattgaaaaagaagattatctcaatgctttcttaattattgctgcgacggataatgcggcagtgaacaaagaaattgcccaatccgcttcgccttttcagcttgtcaattgtgtcagtgacgctgagcttggcaatgtatatatgccgaaaatcgtcaaaagagggcatgtcactgtgtctgtttctacaagcggagccagtccaaagcacacgaaagagcttgctgaaaacgtggataagctgattgacggcgattttgttgctgaagtgaacaggctttatcaggtgagaagaaagaaataagccagagcatacaaatgctctggcttttctttatgcggctcagctttttttgagcttgatgacagtatcagcatcaggcgtgacaaagacggtatgctggctgtcataggtgacgaaaccgggtttcgcgccgtttggttttttgacatgcctgatttttgtataatctacaggcactgaacttgaatctttagcttttgaaaaataagctgcaattgtcgcggcttccatgattgtttgctcatccggttcgctgcttctgatcacaacgtgggagcctggaatgtccttcgtgtgaagccagatatcgtctctggccgccactcttgtcgttaaatattcattttgacgattgttcttacccactaaaattgtcagccctgaggtggattcatatgtttctaacaccggattgtgcggtttttgctttttctggcctttttgctgcttagggcgtaaatatttgccctctacgagctcttccctgatttcgctgatatcccggggagaagcggacgaaagctgctgaatcagctgatcaaaatattcgatctcttcctgtgccagcctgatttgctcctcgacaactgcgaccgaatttttcgctttctgatacttcgtgaaataggcctgtgcgttttcagaaggcgttttgttcgggtttaaaggaatcgtgattgtcgggctttcttcatcataataattgatgacctcagcctgtttatcaccttttttcagcatatataaattagcggttaaaagctccccgtaaagctgaaattccttcgcgttttccgaatactccaaggttttctctaattttttaattttgttggcattcttcttccgttcgttcacaacaaaacgctcaagatcctgagcctgctgtttgacccggtctcgttcagcttttccgaaataaaaacggtcgagcagttcgcttaatgaatcaaaacggcgcgcttcgccctttagatgagtcagctccagcagataaaaatattcctttccgtttacagtcgtaatgttgggaatgaaacggtgctctttcacttcggcaaacagtgccagcaacgcttttggcagtgtgactttgttagcaaggcctgctctgtgaactgcttctttggcgaaaagcggagacacgcctgaaaagtggtcgacaatttgtttatcaagccttccttcttgaaagctgaggtgacgcaaaatatcatcttctgacacctcaagaggcgatattttgtcctgagcaggcggaagcttataatcttggccgggcagtactgtacggtagctgttcattgacggtgataaatgcttaagtccgtcgataatcacattttctgctgcgtcagtcaaaatgatattgctgtggcggcccataatttctacataaagctttcgtacggtttcatcgccaatttcgtttcggcttttgatatgaaaaatcatgatgcggtctaagcccgcttgttcaattttctcaatgaatccgccttcgatatgctttctcagcaacatgcaaaacattggcggttcgcttggattttcataagcttgtgccgtgatatgcacccgtgaatagctcggatgtgccgataataatagtttttggttttttcccttggcacggatgtggaaaatcacatcgtgcttatatggctgatggacttttgtaattcgtccgcccattattttttcattaagttcgtgtgtcattccgtatgtaaacatgccatcaaacgacatatgcaatacaccctctcattcttcctgcattcgataattatagcatgaaatgggacgagtcagaataagcatgcttatagagtgatatctctataagagagcaggggagtggacgagcggaatgaagtttcatgaaatgggacaaacagatttactagaggcaaccaatacgtccatgaaacaaggattaactgaaaaagaggtaaaaaaacgtcttgacaagcatggaccaaacgagctgcaagaagggaaaaaaacttcagcgcttctcttgtttttcgcgcagttcaaagattttatggtgcttgttcttctggcggcaacgttaatctcaggttttcttggtgaatatgtagatgcggttgcgattattgcgattgtgtttgtgaatggcatactcggtttctttcaagaaaggcgtgctgagcaatctcttcaggctttaaaagagctttcaacaccgcatgtcatggcactcagggaaggaagctggacaaagattccttctaaggaacttgtgccgggggatattgtgaaatttacgagcggggacagaattggcgcagacgttcgaattgttgaagcgagaagccttgaaatagaagaatcagcgctgaccggggaatcaatcccggttgtgaagcatgctgataaattgaaaaaaccggatgtttcacttggcgatattaccaatatggcatttatgggaacgattgtgacccgcggcagcggtgtcggggttgtcgtcgggacaggaatgaatacggctatggggaaaattgccgacatgcttgaatcggcagggacattgtcaaccccgctgcaaagaagactggagcagctcgggaagattttgattgttgttgcattgcttctgaccgtacttgtcgttgctgtcggtgttattcagggtcatgatctgtacagtatgtttttagcaggtgtctcgttagcggtagccgctattccggaggggctgccggcgattgtgacagtggcgctttcgcttggtgtacagcggatgattaaacaaaaatccattgttagaaagcttcctgctgttgaaacgcttgggtgtgcgtctatcatttgttcagataaaacagggacaatgacccaaaacaaaatgacggtgacacatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatattgagaaaagagacggcgaatatgtgcttgacggagatccgacagagggagcgctgctcaccgcggcaagaaaaggcggtttttcaaaggagtttgttgaatcaaactaccgggtgatcgaagaatttccgtttgattctgcacggaaaatgatgactgtcatcgtagaggatcaagacagaaagcgttatatcattacaaaaggtgcaccggatgtactgatgcagcgatcttcccgtatttattatgacggctcagcggctcttttttcaaatgaaagaaaagcagaaacagaggcggtattaagacatttggcatcacaggcgctcagaacgatagcggtcgcctacaggccaataaaagcaggcgaaacaccgtcaatggaacaggcggaaaaagatctgaccatgcttggcctttcaggtatcattgatccccgcggccggaagtcagacaggcgataaaagaatgccgtgaagcaggaattaagaccgttatgataacaggtgatcatgtagaaaccgctaaagcgatagcgaaagacttgcgcctccttccgaaaagcggcaaaatcatggacggcaagatgctgaatgaactttctcaagaagagctttctcatgtggtggaggatgtatatgtatttgcccgcgtttcccctgaacataaactaaaaatcgtaaaagcctatcaggagaacgggcatattgtggcgatgacgggagacggcgtcaatgatgctcctgccattaaacaagctgatatcggcgtctctatgggtattaccgggacagatgtggccaaagaagcatcatctcttgttctcgtagatgataattttgcgacgattaaatcagcgataaaagaaggcaggaacatctacgaaaatatcaggaagtttatcagatacctgttggcgtctaacgtcggagaaatccttgtcatgctgtttgcgatgctgctggcccttcctttaccgctcgttccgattcagattttgtgggtcaacttggtgacggacggattgccggcaatggcgctcggcatggatcagccggaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttggcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccggggactggatgctcgtcatcggtatgtccgccatccctacttttttgctggcggggtcacttttaacaagaaaaaaataaattcatatgatataatcttaggggtaatagcgtgtctattgcccttttattatgagaacagggaagaattgggtgttttaaaatgatacgaagtatgacaggcttcggcagtgcaagcaaaacacaagacgatctctctgtaagcgttgaacttaaatctgtgaactacagatttaaagaagtgaacgctcgtttgccaaggcctttgctatattttgaagataagctgaaacagaccattctgcagcatattcagcgcggaagaattgagcttttcgtatccgttgacagcgatatgcttgttgagaaaaggcttgaaattgattggccgctgctcgatgagtttgtcgcagccgcgagagatatgaagaagcggtatcaattgtctgcagagcccgatgtaatggatttctttaagcttgatcatgtcgtccaggttcatgaagaacagacgcaaaatgacaagctggaggcgttgatcatcgatgctgcagaagaagcggtaaaaggtctctgtgaaatgcgtgaaaaagaggggctgctcttagcgaaagactgcctgatgcatattgatcagcttgaagagctggtgagagaaactgaattgctggctgcagatgtcgtatctcgttatcgggaacggctgtacgccagaatcaaagaatggactgaagacgtattagacgagagccggcttgtaacagaatgcgctatttttgcagaccgctctgatatcactgaagagattacaagactgaagagccacttcgcccagtttcgtgatatattagctagtggcggagctgtcgggcgcaaactcgactttcttgttcaggagctcaatcgggaagcaaatacgattggctcaaaagcaaatgatcatcagatcacaaagcttgtcgttgaaatgaaaagttctattgaaaaaataaaagaacaagtgcaaaatatagaatagtgactgtgcgtattgtttacagacggtcttactaggctaaactagagacgtctattttacagggggaacgtagaagatgacgattaaactgattaatatcggatttggcaatatcatctccgccaatcggatgatttcgattgtcagcccggagtctgcgccaatcaaacggatgattcaggatgcaagagaccgcggaatgctaattgacgctacatacggacgaagaacccgtgcagttgtcgtcatggatagtgatcacattatcttatctgccgtccagcctgagacagttgcacacagactttctgttaaagaagaaattatggatgaagggcaggggtaattgccgcatgaaagaaagagggttattaatcgttctctcaggtccctcaggagttggtaaaggaacggttcgacaagcaatcttttcgcaggaagacacaaaatttgaatattcgatttcagtaaccacaagaagtccaagagagggcgaagtgaacggagtcgattattttttcaaaacaagagacgaattcgaacaaatgattgcggacaacaagctgcttgaatgggcagagtatgtcggcaattattacggcacgccagtcgattatgttgaacagacgcttcaagatggaaaagacgtctttttagaaattgaagttcaaggggctcttcaagtgagaaatgctttcccggaaggcctgtttattttccttgcgcctccaagcctttctgaactgaaaaacagaatcgtgacacgaggcacagaaacagacgctctgattgaaaatcgaatgaaagccgcaaaagctgagatcgaaatgatggatgcttatgactatgtcgttgaaaacgataatgtcgaaacggcttgcgataaaatcaaagcaatcgttcttgctgaacatttgaagcgtgaacgcgttgcaccaagatataagaaaatgctggaggttgaataatcaatgttagatccgtcaattgattctttaatgaataaattagattcaaaatatacgctggtgactgtttctgcgagacgcgcacgtgaaatgcaaatcaaaaaagaccaaatgattgaacatacgatttcacacaaatatgtaggcaaagctttagaagaaattgatgcaggcctgctttcgtttgaaaaggaagaccgcgaatagtagcacaagtagcaacctatatcatgtaggttgttatttttttccgtgcggttttgtaaagtgcagagggggagaattcattgctaaacaatcgaaatgtgttactttgcgtgagcggaggcatcgctgtttataaagcctgtgcgttaacgagcaagctggttcaggcaggagcaaatgtcaaagtgattatgactgaatccgcttgccgattcgtttcaccgctgacatttcaggcattgagccgccacgaagtctatacagatacatttaaagaacaaaatccaagcgttatttctcatattgatgccgcagactgggccgacttgattatcgtagcgccggctacagctaatgtgattggaaaactggcaaacggcatcgctgatgatatgctgacgacaacattgttggcagcaacggctcccgtttggatcgcgccggcaatgaacgttcacatgtatgaccacccggcagtcaaacgaaatatttctgttctttatcaggacggttatcgttttattgagccaagtgagggctatttagcatgcggttatgtaggaaaaggcagattggaagagccggaaaacatcgtaaagctggccgaaaaacattttgctgaagaaacatccgctcctttagaaggcaagcatgtggtcgttacagccggcccaacgcgggaagcggttgatcctgtccggttttttaccaataaatcgacgggcaaaatgggctacgcattagcggaggctgctgttcagctcggcgcacgggtaaccttaatttctgggcctgtttcacttgatcagcctaaaggccttgctgagtttatccctgttcaatcggctgcggatatgcgcgaagctgtgctctctgtgtatgacgcaagcgatatagtcattaaaacagctgcggtagccgattttacgccgaaaacagtatttgaccataaaatgaaaaaacaagacggcggcatgaccttagaactgaaaagaacagtcgacattttgaaagaattgggcgagaaaaagaaagagcagattttggtcggatttgccgccgaaacacaagacattgaacactatgcacgtaaaaagctcgccgctaaaaaccttgatttgattgtggcaaatgatgtgaaagcaaatggggccggttttggtgctgatacgaatatcgtgacaatctttttcaaagacgggcataaacgcgaactcccgatcatgtctaagctcgatgtttcttttgaaatccttcaggagatcgcagccctctcaaaacaaaccggagagcgctcatgaattttgcagaagtcatcgttgatgtcagcaccaaaaatatagacaggccttttgattataaaatcccagaccatctcaagggcatgatcaaaacggggatgcgggtcattgttccatttggcccccgtaagattcaagggtttgtgacagcagtcaaagaaacatctgacctatcggggaaatctgtcaaggaagtagaggatttattagatcttacacctgttctgacagaagagcttatggatctgtcatcatggctgtcagacaaaacgctgtcttttaaaataacggcgcttcaagcaatgctgcctgccgccttaaaggcgaaatatgaaaaagaattaaaaattgcacacggcgccgatcttccgccgcaagtggaacggctgttttctgaaacaaagacgctgctgtattcagatatacccgatcatgatacgctgaaactgattcaaaggcatgttcaaaaaggggacattgacgtgacgtataaagtcgcgcaaaaaaccaataaaaaaatggtcaggcatattcaggcaaatgcgagtaaagaagagcttgctaagcaggctgagggattgtctcgccaagcagcaaaacagcaggcgattcttcactttctcatctctgagccggaaggtgtgaaaattcctgcggcgcaattgtgcaaaaaaacggacacgagctctgcaaccatcaaaacccttatccaaaaagggcttttgaaggaaagctatgaagaggtttatagagatccctatcaggacaaaatgttcaaaaaaacagagcccctgccgctgacagacgaacagagggctgccttcgagcccatacgcgagacattggacagcgatgagcataaagtgttcctccttcacggcgtgacaggaagcggaaaaacggaaatttatctgcaatcaattgaaaaagtactggcgaaaggaaaagaagccatcgtcctcgtacccgaaatatcgctgacgccgcaaatggtcaaccgcttcaagggccgcttcggctcccaggtggcagtcatgcacagtggtttatccacaggagaaaaatatgacgagtggcgtaaaatccaccggaaggaagtacggcttgtcgtcggtgccagatccgccatttttgctccgtttgaaaatctcggaatgataatcatcgatgaagaacacgagtcttcctataaacaggaagaaatgccgcgctatcatgcgaaagaggtggcaatcaagcgggctgagcatcacagctgcccggttgtattagggagtgctacgccgacattagaatcatatgcaagagcgcaaaagggcgtatacgagcttctttcactgaagcaccgtgttaaccatcgggtgatgcccgaggtttcgcttgtcgatatgagagaggagcttagaaacggcaatcgctcgatgttttcggttgaattgatggaaaagcttgaagaaacgattgcaaagggtgagcaggcggtgctgtttttaaataagaggggctattcttcctttgtgatgtgcagggattgcggctatgtcccgcaatgcccgcactgcgacatttccatgacgtatcatcgttacggccaaaggctgaaatgccattattgcggacatgaagagcctgttccgcacacttgtcctgaatgcgcaagcgagcatatccgctttttcggaacgggaacacagcgagtggaggaagagctgacaaaagtgctgccaagtgcgagagtgattcggatggatgttgacacgacatcacggaaaggcgcccatgaaaaattactgtcagctttcggagaaggaaaagcggatattcttctcggaacgcaaatgatcgcgaaagggcttgattttccgaatgtcacgcttgtcggagtgttaagtgctgatacaacacttcatattcctgatttcagatcggctgaaaaaacatttcagctgttaacgcaagtcagcggccgggcaggcaggcatgaaaagcccggccatgtcatcattcaaacgtatacaccgtctcattacagtatccagctgacgaaaacacacgattatgaaacgttctatcagcatgaaatggcgcacaggagagagcaatcctatccgccatactactatttggctcttgtgactgtttctcatgaggaagtggcgaaagcagcggttacagctgaaaaaatcgctcattttttgaaagcaaactgcggagctgacacgaaaattctcggaccaagcgcgtcgccgatagccaggatcaaagatagatatcgctatcaatgcgtgataaaatacaaacaggaaacccagttatctgctttattgaagaagatactggaacattataaacgcgaaattgaacaaaaacatgtaatgatttcaattgatatgaatccttatatgatgatgtaagatctcacgtcttggagggtaacaaattggcagtaaaaaaggtcgtcacacatcctgcggaggttttggaaacacctgcggaaaccgtgactgtttttgataaaaagctaaaaaaactgcttgatgatatgtacgacaccatgcttgaaatggatggtgtcggactggcagcgccgcaaatcggcattttaaaaagagcggccgttgtagatatcggggatgacagagggagaattgatctcgttaatcctgaaattttagaaagaagcggcgagcaaaccggaattgaaggatgcttgagctttcctggcgtctatggtgatgtcaaacgtgccgattatgtcaaagtgcgtgcgtttaaccgtcagggaaaaccgttcattctggaagcgcgaggctttttagcaagagccgtgcagcatgaaatggaccacttagacggtgtgctgtttacatctaaaataagtaaatactatacagaagatgaactagcggatatggaaggatgatttgatgacgagaatcgtatttatgggaacgccggatttttcagttcctgttttaagaaccctgattgaggacggatatgaagtagtgggggtcgtcacacagccggaccgtccgaagggcagaaaaaaagtcatgacacctcctccggtcaaggaagaggcattgcgtcacggcatcccggttcttcagccggaaaaagtcagattgacagaagaaattgagaaagtgctggcattaaagcctgacctgattgtaacggcggcattcggacaaattttgcctaaagagcttctcgacagtccaaagtacggctgcattaacgttcacgcatcccttttgccggaactgcgcggcggtgctccgattcattattccattctgcagggaaagaagaaaaccggggttaccattatgtatatggtagaaaaattggatgcgggcgatatgatctcaaaagtggaagtggacattgaagaaaccgacaatgtcggaacactgcacgataaattaagcgcggctggcgcgaagctattgtctgaaacggttccaaacgttattgccggcagcatttcacctgaaaagcaggatgaagagaaagcgacatacgcgcctaatatcaaaagagagcaagagctgctcgactggtccagaacgggcgaagagctttacaaccagatccgcggcttaaatccatggcctgttgcttatacgactctaaacggacaaaacttgaaaatatgggcgtcgaaaaaaatagcggcaccaacaacagctgagcccggcacagtcgttgcagttgaaaaggaaggaattatcgttgccacaggtaatgatacggccctgttattaaccgaacttcagccggccggcaaaaaacgaatgaaaggcgaggactttgtgcgaggcgctcatgttgaagccggtgatgtgttaggagtaaacaatgaaaaaaactagtgttcgtgacatcgcccttgaggcgctgatcaaattagaacaaaaccaggcatatagcaacctgctgctgaaatcggtcattaaatcaaatgaactgagtgatcaggacagagggcttttgactgaacttgtctatggtacattacaaaataagatcgcgcttgattatatgcttaaaccgtttatcaataagcctcaaaaggtaaaggcgtgggtgattcagctacttcgcctatccttatatcaaatggagtatttagagaagattccagacagggcagccatccatgaagcggttgagattgctaaaatccgcggacacaaaggcattgcttcatttgtcaacggcgtgctccgttctattcagcgcgaaggtgttccatcctttgacgcgatcgaagatcctgtacgccggctggcgacagaaacaagccatccggaatggcttgtgaaagagtgggcggatgcgtatggatttgaagctgcggaaaagatttgccgcatccatctcattccgccgaagcagacgctgcgtgtcaatgaaatgaaagcagacagagctgagctgcttgaccaaatggctgctgagggaatcgaagttgaaaaaggcgacctcgctgaagatgctgtgaagctcttaaagggaacaattgccggaactcatttcttccaaaacggcgaagtttccatccaggatgagagctccatgctcgtcgcccgcgcccttgaccctaagcctgatgaaacagtgcttgacgcgtgtgcggcgcctggcggaaagtcggctcatatcgcagaattaatgaagaacaaggggagcgttacgtcgcttgatcttcacaaacataaagtgaagctaatcaaagaagcggcagatcggcttggcctgacaatcattcatgcggaaacaatggatgcaagaaaagcaggggaaacgtttgaaaacgaacagtttgaccgaatattggtcgatgccccgtgctcaggtttcggtgttatcagaagaaagccggacatgaaatacacgaaaaagcctgacgacagcgcccgtctagctgaaatccagctgtcgatcttgagggaaatcgcaccattagtaaaaaaaggtggcactcttgtctacagtacgtgtacaatggaccggacagaaaatgatgaagtaatacatgcgtttatacaagaacatcctgattttgaacccgatttgtctcttgaaaagcggctgcctgaaaaggtgagaccctttgttcgggatggaaggcttcaaatccttcctcattatttcggaacagatggtttctttatttgcagcatgagaaagaagggataagcaatggcagaacttaataaaacaaaagtaagaaaagaattgcggacagagcgtccgtctatttattcttttgaattagatgaaattaaacaatggctgacagacaacggagagaaaccgttccgtgcggctcagatctttgaatggctatatgaaaaacgcgtatcttcttttgaagaaatgacaaacctctcaaaggatctgcgtgagaaattaaacactcactttgtgttaacaacgctgaaaacggctgttaaacaaacttctcaagacggtacgatgaagtttttgtttgagcttcatgacggttataccatcgaaaccgttttaatgagacacgagtatggcaattctgtatgtgtaacgacacaagtcggctgccgtattggctgcacattctgcgcgtcaacgcttggaggcttaaaacgaaaccttgaagcaggggaaattgtcgctcaagtagtcaaagtgcaaaaagctcttgatgaaacggatgaacgcgtcagctctgtcgtgatcatgggaatcggcgaaccttttgataactttaacgaaatgctcgctttcttgaaaatcattaaccatgacaagggcctgaatatcggtgctcgccatattacggtctctacgagtggaatcatcccgaaaatttacgaatttgctgatcagcaaatgcagattaactttgcaatttctctgcacgcgccgaacacagaaatcagaagccgtttgatgccgattaacagagcatataaactgcctgatctaatggaagccgttaaatattatattaataaaacgggacgccgcatcagctttgaatacgggctgttcggaggtgtaaacgaccaggtggaacacgccgaagagcttgccgacttgctggaaggagtcaaatgccacgtgaacttgattccggtaaactacgtgcctgaacgggactatgtgcgcacaccgcgtgatcagatttttgcttttgaaaaaacgctgaaatcccgcggagtaaatgtcacaatccgaagagagcaaggacatgacattgacgcagcctgcggtcagcttcgcgcgaaggagcgtcaagacgagacgaggtgatgagggttgttaacagccttaaaaacagatacaggaaaaatccgccagcataatgaagatgatgcggggatattcaaggggaaagatgaatttatattagcggttgtcgctgatggcatgggcggccatcttgctggagatgttgcgagcaagatggctgtgaaagccatgggggagaaatggaatgaagcagagacgattccaactgcgccctcggaatgtgaaaaatggctcattgaacagattctttcggtaaacagcaaaatatacgatcacgctcaagcccacgaagaatgccaaggcatggggacgacgattgtatgtgcgctttttacggggaaaacggtttctgttgcccatatcggagacagcagatgctatttgcttcaggacgatgatttcgttcaagtgacagaagaccattcgcttgtaaatgaactggttcgcactggagagatttccagagaagacgctgaacatcatccgcgaaaaaatgtgttgacgaaggcgcttggaacagaccagtcagtcagcattgacacccgttcctttgatatagaacccggagacaaactgcttctatgttctgacggactgacgaataaagtggaaggcactgagttaaaagacatcctgcaaagcgattcagctcctcaggaaaaagtaaacctgcttgtggacaaagccaatcagaatggcggagaagacaacataacagcagttttgcttgagcttgctttacaagttgaagagggtgaagatcagtgctaatcggcaagcggatcagcgggcgttaccaaattctccgcgttataggtggcgggggaatggccaacgtgtatttagctgaggatatcattctagaccgtgaagtcgcaattaaaatcctgcggtttgactatgcaaatgacaatgaatttatcagacgtttccgcagagaagcccaatccgcatcaagcctcgatcacccgaatattgtcagcatttacgatttgggcgaggaagatgatatttattatattgtcatggaatacgttgaaggcatgacgcttaaagaatacataacagcaaatgggccgcttcaccctaaagaagcgctgaacatcatggagcaaatagtctcagccatcgctcatgcccatcaaaaccagattgttcacagagacatcaagccgcataacattttgattgatcatatgggaaatatcaaagtaacggattttggaattgcgacggcactaagttcgaccacaatcacccataccaattcagttctgggctcggtccattacttatcacctgaacaggcccggggcggcttagccacaaaaaaatcggatatttatgcgcttggaatcgttctatttgagcttttaaccggccgtattccgtttgatggagagtcagcagtcagcatcgccttgaagcatcttcaagcggaaactccttcggcaaaaaggtggaatccatcggtcccccaaagcgttgaaaacatcatactcaaggcaactgccaaagatccttttcatcgctacgaaacggctgaagacatggaagcagacataaaaacagcttttgatgccgacagactcaatgaaaagagatttacgattcaagaagatgaagaaatgacaaaagcgatacctatcattaaagatgaagaactcgctaaagctgctggcgaaaaagaagctgaagtgacaaccgcacaagaaaacaaaacaaagaagaacggcaaaagaaaaaagtggccgtgggttttgctcacgatatgcctcgtttttatcacagctggaattcttgctgtcactgtttttccgtcgcttttcatgcctaaggatgtcaaaatacctgatgtctccggaatggaatacgaaaaagccgcagggctcttggaaaaagaaggtttacaggttgattccgagttgttggaaatctcagatgaaaaaattgaagagggcctgatggtaaaaacggatcctaaagcggataccacagtcaaagaaggcgccacggtcaccctttataagagcaccggaaaagcaaaaacggagatcggtgatgtgacaggccaaacggtcgaccaggcaaaaaaagcgttgaaggaccaagggtttaaacatgtaacagtaaatgaagtgaatgacgagaaaaatgcgggcactgtcattgaccaaaatccttcagcagggactgagcttgtcccgagtgaagatcaagtcaaacttacagtcagtatcggacccgaagacattacgcttagagacttgaaaacctacagtaaagaagcagcgtctggatatctggaggacaacggattgaagcttgtagaaaaagaagcatactcagatgatgttccagaaggacaggttgtcaaacaaaaaccagcagcaggtacggcagtaaagcccggaaacgaagttgaagtgacattctctctcggaccagagaaaaaacctgcgaaaacagtgaaagaaaaggtcaagatcccctacgaaccagaaaatgaaggggacgagcttcaagtgcaaatcgcggttgacgatgcggatcacagcatctctgacacttacgaagaatttaagataaaagagccgactgaacgaacgatcgaactaaagattgaacccggccaaaaagggtactatcaagtaatggtaaacaataaagttgtcagctacaaaaccattgagtatccgaaagatgaataacaaggagggaaaatatgcctgagggcaaaattattaaggcgctaagcggcttttactatgtactggatgaatcagaggattcagataaagtaatacaatgcagaggaagaggcattttcagaaaaaacaaaattacccctcttgtcggtgattatgttgtgtatcaagctgaaaatgacaaagaaggatatttaatggaaattaaagaaagaaccaacgagcttatcaggccgccaatttgcaacgttgatcaagcggtccttgttttctcagcggttcagccttctttcagcacggcattgctcgaccgcttcctggttctcgttgaggccaatgatattcagccgattatatgcattactaaaatggatctgattgaagatcaagatacagaagatacgatacaagcctatgcagaagactatcggaatattggttatgacgtataccttacctcctctaaggaccaagacagtttaacggacatcatcccgcattttcaggataaaacaacggtatttgccggtcagtccggtgttgggaaatcctcgcttctcaacgcgatcagtccggagctcggattgagaaccaacgagatttccgagcatttgggccgcgggaaacacacaacccgccacgtggagctgattcacacgtccggaggtttggttgcagatacgccgggattcagctcgcttgaatttacagacattgaggaagaagagctgggctataccttccctgatatcagagaaaaaagcgcttcatgcaaatttagaggctgtttacatctgaaagagccgaaatgcgcggtgaaacaagctgttgaagacggggaattaaagcagtatcgctatgaccattatgttgaatttatgacggagattaaagacagaaagccgaggtattagcataatgataaaggttgcaccatctattctttccgctgattttgccgctttaggcaatgagattaaagatgtagaaagaggcggagccgattgtattcatattgatgttatggacggccattttgtcccgaatatcacaatcggtccgctgattgtagaagcggtccgaccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtagttctaaacccgcatacccctgtacaagtcatcgagcatgttttcgacgatctcgatcttgttcttttaatgacggtgaacccgggcttcggcgggcagaaatttattcattcagtccttcctaagataaaagaggttaagcgaatggcggatgaaaaaggaaaaaaagatctgttaattgaagtagacggcggcgtcaacaaagaaaccgctccgctcgtcattgaagcgggcgcaaatttactcgttgccggttcagctgtttatgggcagtctgaccgcaaaaaagcaatttctgaaatcagaggaagcaaataagcagctttagaaaagagctgggcatacaatagcctaagctctttttcctgtatgcagagaaaggaatcagagatgaaaacaattaatatcgttgcgggaggcccgaaaaatctcattcccgatctaaccggctatacggatgcacacacgctttggatcggtgttgacaaaggcaacgtcactctcttagatgcagggatcatacctgttgaagccttcggagattttgacagcataaccgagcaagaacgccggcgaatagaaaaagccgctcccgcccttcatgtgtatcaagcagaaaaagatcaaacagatttagacctcgcccttgattgggcgctggaaaagcagccggatattattcagattttcggcattacaggcggcagagctgatcattttttaggaaacattcagcttctgtatagaggtgtaaaaacgaacataaaaattaggctgatagacaaacaaaatcatattcaaatgttccctcctggtgaatatgatattgagaaggatgaaaataagcgatatatctccttcataccgttttccgaagacatacatgagctgaccctgaccggttttaaatatcctctaaataattgtcatattacgctcggttcaacactatgtattagtaacgaactcattcattcacgaggtactttttcgtttgcaaaaggcatattaataatgataagaagcacggattaagcatgtgctttcattcaattgctgaaaacaatgaacaaggcggttacgggacgttataggaggggacaaaaatgaaattttacaccattaaattgccgaagtttttaggaggaattgtccgggcgatgctgggctcatttagaaaagattaaggcccaggggttcaaagccctctttcaccacataaaaacgcctgccacatatcggggcaggcgttcattttgttatacacgctcaactttaccggatttcaaagctcgagcagatacatatacttttttaggttttccgttcacaaggatacgaaccttttgaagattcgcgccccaagtgcgcttagaagcgttcattgcgtgagaacggttattcccagctgttgtttttttacctgtgataacgcatttacgtgccatttgtttccctcctcacttgcacaaaacatctactttttaacattcatataatcttagatgctttcgatatggatactttaaataatttaccacagctaaaaaacgtttgcaactattgtttcatcatctttcaagaaaattcacttgacatcttgcggaaacagcagcgctatagtatatgtagaggtacggccagcgattattgcctggtcttttcataatggaaaccatatagtagaatagctgtaactctatgcattcgaaggaggaactagtgtgtccattgaattaagaacgaagtacggacagattgatatatctaatgaagtcatcgcgatggttgcaggaggcgcggcggttgactgttacggcattgtcggcatggcctctaaaaaccagattaaagacggactgactgaaatccttcggaaagagaatttcagcaggggtgtccaagttcgccaagaaggagaacagatacatatcgacatgtatatcattgtcagctacggcacgaaaatttctgaagtggcacataatgtccaaacaaaagtaaagtacacagtaaatcaaaccatcggactggcagtggattctgtcaatatttatgtccaaggcgtacgagtgacgaacccgtagttaggaggagtaggattgtctatcagaacattagacggcagaacctttgccgagatgattcttgcgggagcgcagaatctgtctcaaaacgccagtgcagttgatgcactgaacgtgtttccggtgccggacggtgatacgggaacaaatatgaacctgtcgatgacttccggagcaagagaagttgaacaaatggatacggatgatatcgggaaggtgggctccgcgttatctaaagggctgctcatgggagcacgcggaaattcaggagttatcctatcccaattgttccgcggatttagcaaaaacattgaaacgaaaaaagaaattaatgcacttgagtttgccgctgcgctgcaagcaggtgtagacatggcgtataaagctgtcatgaaacctgtagagggcaccattttaacagttgcaaaagacgctgcaaaaaaagcaatgatcttagcagaaaaagaaaccgatatcactgcgctgatgactgcagtgacagaagaagcagaggcgtctttaaaccgcacccctgaattgctacctgtcctaaaggaagtaggagttgtcgatagcgggggcaaaggcctgctctgtgtgtatgaaggttttcttgcttcattaaaaggtgaaactgtacctcagaaagcagttcttccgtcacttgacgacatggtcagcgcagagcatcacaagagcgcgcaaagcatgatgaataccgaagatattgaatttggattctgtaccgaagtgatggttaggcttgatcagacaaaaagagagttcgacgaaggcacgttcaggcaagacctcagccagttcggagattctctgcttgtgattgcggatgaatcgctggcgaaggttcatattcatgctgaagagccgggaaacgtgttaaactacgcccagcattacggtgaattgatcaaaataaaaatagaaaatatgagagaacagcatacctctatcatcagtcaagaaagcaaacctgcagacaacgaaacaccgccggcaaaacagccgtatggcattgtgactgtagcgatgggagaaggaattgcagacctatttaaaagcattggcgcttctgttgtgattgaaggcggccagaccatgaacccaagcactgaggatattgttgatgccgtgaagtctgtaaatgcagatacggtatttatcctgcctaacaactccaacattatcatggctgctaaccaagcggccagcgtagtggatgaacaggtttttgtcattcctgctaaaacggttccgcaagggatgtcagccctgctggcttttaacccggatcaagcagctgaagcgaacgaggccaatatgctaagcgccattcagcaagtaaaaagcggacaggtgacgttctcagtcagagatactcatattgatggtaaagatattaaaaaaggcgactttatgggcattctgaatggaacgattatcggcacttctgaaaatcagctgtcagccgcgaaaatgctgctgtcagaaatgatcggagaagatgatgaaatcgtgaccattctatatggtgaggatgcgtctcaggaagaagctgagcagcttgaagcgtttctcagtgaaaagtacgaggagattgaggttgagatccacaatgggaaacagcctctgtattcgtatatagtttctgcagaatagaagggcaaattgcccttctattcttatgtctgcttttaagtgcggcagcgctgtaacgcgtccgcttgccattttatatctgatcaattagtctagaagcaaagcgctaataagctctggttcataaggaggaatagcatgaaatacagaagcgtttttgatattatcggcccggttatgatcggtccgtccagctctcatacagcgggagctgctagaatcgggagagtggccagaagtttatttggcagagagcctgagcgcatcattgtatctttttacggctcgtttgcggaaacgtataagggccacggcacagatgtcgcgattatcggcggattgcttgattttgatacattcgatgaacggattaaaaccgctatacaaattgcagaaactaaaggaattgatatagagtttcgggtagaagacgcagtcccggtccatccgaacacagcaaaaatcaccatttctgatgaaaagggtgagcttgaactgacgggtatttcgattggcggaggaaagattgaaatcacagaattgaatggttttgagctccggctgtcaggaaatcatccggccatattagttgttcataatgacaagtttggcacaattgccggtgttgccaatgttctggcgaaattttcaatcaacgtaggacatatggaagtagcccggaaagatatcggccagcttgcgctgatgacaatagaggtcgaccaaaatattgacgaccacattctcgacgagctgtcgaaactgccgaatattattcaagtgacaaagattgctgactagcgaaaagggtcaggaggagccagttatgtttcgtaatgtaaaagaattaattgagattactaaagaaaaacaaatattgatctctgatgtgatgatagctcaagagatggaagtaacagaaaaaacaaaagaggacatttttcagcagatggatcataacctgtctgttatggaagcggcggttcagaaaggactcgagggagttacgagccaaacgggcttaacaggcggagatgccgttaaattgcaggcctatattcgatcaggaaaaagcctgtctggcccgctgattttagatgctgtatcgaaagccgttgcaacaaatgaagtaaatgcagccatgggaaccatctgtgcgacaccgactgcaggttctgccggtgtggtgcccggtacgttatttgctgtaaaagaaaagctgaatccaacaagagaacaaatgatccgctttttgtttacagccggggctttcggatttgtcgtggctaataacgcaagcatttccggcgccgccggaggatgtcaggcagaggttggatcagcttcaggcatggcggctgcggccattgttgaaatggcaggaggaacacccgaacaaagcgcggaagccatggccattacattaaaaaatatgctaggcctcgtgtgcgaccctgttgcagggcttgttgaggtgccttgcgtgaaacggaatgcgatgggcgcgtcaaatgcgatgattgccgctgatatggcattggcgggcattacaagccgtattccatgtgatgaggtgatcgatgccatgtataaaataggccaaacgatgccaactgcacttagagaaacaggccagggcggtttagcggcaacaccgacaggaagagaattagagaaaaaaattttcggaggagcgctaggttcacgtgatacaacatcagcaaactagtatagctaacattaagggtattgggccggaaacagaaaaaacattgaatgaactcggtatttatgacatttctgatcttctgaattatttcccttatcgctatgatgactacgagctgagggatttagaagaagtaaagcatgatgaaagagtcacagtcgaagggaaggttcattcagagccttctcttacctattacggaaaaaaacgaaacaggctgacattcaggcttctggtcggccactatttaattacagccgtatgttttaaccggccttatttgaagaagcagctttcgctcggctctgtggtgacggtttcaggtaaatgggacaagcaccgccaaaccatctctgttcaggagttgaaaaacgggccgcatcaagaagacaaaagcattgaaccagtgtattctgtgaaagaaaatgttaccgtcaaaatgatgaggcgctttattcagcaggcgctgacccaatatgcagactcacttcctgatcctcttccggaaaagctaagaaaaagctataaactgcctgactattatcaagcgttaaaagcaatgcaccagcctgaaacaagggaagcattaaagcttgccagacggcggtttgtttatgaagaatttttgttgtttcagttgaaaatgcaggcgttccgaaaggcggaaagagagcagacacaagggatacggcagcgtttttcaaacgaagaactcatgagatttatcaaaagcctcccgtttcccctcacaaacgcccagtcacgcgttcttcgcgaaataacagcagacatgtcttctccatacagaatgaaccgtcttcttcaaggggacgttggatcaggaaaaacagcagtcgccgccattgcactgtatgccgcgatcctatccggataccaaggagcgctcatggtgccgacagaaattctggccgagcagcatgctgattcgctcgtttcgctatttgaaaaatgggacgtcagcgttgctcttttgacaagctctgttaaaggaaagcggcgaaaagaactgcttgagcgtcttgcggcgggtgagattgatattcttgtaggaacccacgctttaatccaagacgaggtggagtttaaggcgctgagtctcgttattacagatgaacagcacagatttggagttgagcagcgcaaaaagcttcggaacaaagggcaggatcccgatgttctctttatgacagccactccaatcccaagaacattagcgatcacagtgttcggtgaaatggatgtatctgtcattgatgagatgccggctggacgaaagcgaatcgaaacctattgggtaaaacatgacatgctggatcgtattttggcatttgtcgaaaaagaattaaagcaaggcaggcaggcttatatcatctgtccgctgattgaagaatcagacaagcttgatgtgcaaaacgccattgacgtgtacaatatgctttctgatatttttcggggaaaatggaaggtcggccttatgcatgggaagctgcattccgatgaaaaagaccaggtcatgagagaattcagcgcaaatcactgtcaaattctcgtatcaaccactgttgtggaggttggcgtgaatgttccgaatgcaacgattatggtgatttatgacgccgaccgtttcggactatcacagcttcaccagctgcgcggccgtgttggacggggtgagcatcaatctttctgtattctgatggctgatccaaaatcagaaacagggaaagaacggatgaggatcatgtcggagaccaatgacggtttcgagctgtctgaaaaggatctggaactgagaggtcccggtgatttcttcggaaaaaaacaaagcggaatgccggaatttaaagtggcggacatggttcatgattacagagcgcttgaaacggcaaggcaggatgctgcgaatcttgtggcttctgacgcgttctggaaggagccggaatacgctgtgttaagagatgaattgctgaagagcggagtaatggacggggaaaaattaagctgagtatcagaagtttttggtgttcagccagaaacaatcgttgcattccaatctatgaaattatatactactattagtacctagtcttaattgtccggatggtgtttagatatgagaagaaataagagagaacgccaggaattacttcagcagacgattcaagcaaccccctttattacagatgaagaactagcgggtaaattcggggtgagcatccagacgatacgtttggaccgcttagagctttccatacctgaactgagagaaagaattaagaacgtggcagagaaaacacttgaggacgaagtgaagtccctgtcacttgatgaagttatcggagaaattattgaccttgagctggatgatcaggcgatatccattttagaaataaaacaggagcacgtgttcagccggaatcagattgcgagaggacaccatttatttgcacaggcgaattctttggccgttgcagtcattgatgacgagctggcgctgactgcaagtgcagacatccgctttacaagacaggtaaagcagggtgaacgtgtcgtagcaaaagcgaaagtgacggctgtcgaaaaagaaaaaggaagaacggttgtcgaagtgaacagctacgttggcgaagaaattgttttttctggacgctttgacatgtatcgttcaaaacattcataaaggtggagcatgcatgagaatagctgtagatgcaatgggaggagaccacgctcccaaagctgttattgacggagttataaaaggtatagaggcatttgatgatctccatatcacacttgtcggtgacaaaacaacgatagaatcacatttaacaactacatcagatcgcatcacggtgctgcacgcagatgaagtgattgagcctacggatgaaccggtccgtgccgtgcgaagaaaaaagaactcatctatggttcttatggcgcaggaggttgcggaaaacagagctgacgcctgcatttcagcgggaaataccggtgcattaatgacagccggtctctttattgtcgggagaattaaaggaattgaccgtccggcgcttgccccgacacttccgactgtttcgggagacggatttcttctccttgatgtcggcgccaatgttgatgccaaaccggagcacctcgttcaatatgccatcatgggttctgtttattctcagcaagtgcgcggtgtcacttcaccgagagtcggacttttaaatgtcggaacagaagataaaaaaggaaacgaactgacgaagcagacgtttcaaattttaaaagaaacagcaaacatcaattttatcggaaacgtggaagcgcgagaccttttagatgatgtggcggacgttgtagtaacagacggctttaccgggaatgttacactcaaaacgctggaaggctctgcgttgtctatttttaaaatgatgagagacgtaatgacgtctactttgacatccaagcttgcagcagctgtgctgaagccaaaattgaaagaaatgaaaatgaaaatggagtattcgaattatggcggagcaagtctttttggcttaaaagcgcctgtgatcaaggcgcacggctcttcagattcaaatgctgtattccatgcgattcggcaagcaagagagatggtcagccaaaatgtggctgcgctcattcaggaagaagtgaaagaagaaaaaacagatgagtagtctggaggtttttacatcatgagtaagattgcatttttattccctggtcagggatcacaatttatcggcatgggaaaagagctttatgagcaggtgcctgctgcaaagcgtctgtttgatgaagccgatgaaacgttggaaacaaaactcagctcgcttatttttgagggggatgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttataccgtcagaaaacgcggagagtttatgaatgaagcggtaccggctggcgaaggagcaatggctgcgattctcggcatggatgctgaagcattaaagcaagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgacattccggtcatctcaaatgtttctgctgacgtgatgactgaaaaagcagatatcaaagaaaaacttattgagcagctttactctccggttcgttttgaggaaagcattaacaagctgatcgcagagggtgttacgacttttattgaaatcggtcccggaaaagtgctttcaggccttgtgaaaaaagtaaatagacggttaaaaacaattgctgtatcagatccggaaacgatcgagctggcaattcaaacgcttaaggaggagaatgataatgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggtagatgaaatcaaatcaatgggcagaaaagcaattgctgtaaaagcggatgtatcaaatcccgaagatgtacaaaacatgataaaagaaacattgtctgttttttctacgattgacattctggttaataatgcgggaattacaagagacaatctcatcatgagaatgaaagaagacgaatgggatgacgtcattaacattaacctgaagggtgttttcaactgcacaaaagctgttacaagacaaatgatgaaacagcgttcaggccgcattattaacgtatcgtctatcgtcggcgtcagcggaaaccctggacaggccaactacgtggctgcaaaagccggcgtcatcggtttaaccaagtcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgatcctagcgatgtcagcagtgttgtcacgttcctagcttcagagggagctcgttatatgacaggccaaacgcttcatattgacggcggaatggtgatgtaagttttttctcgaaaatttcatcatagtttctctagttttttaaaaacgaatccactataatacttgaggggaggtgaattgctatggcagacacattagagcgtgtaacgaaaatcatcgtagatcgccttggcgttgatgaagcagacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgccgaaacgcggggctttagccctttattcgtgcagttattacagcatgccgcttttacgcgcgctgtatccggtttagtcagagaagcgcggtgaacctgatgtgcctatggaggttactatgtcaaaacactcacattataaagataaaaaaaagttctataaaaaagtagaacaatttaaagagtttcaagaacggatttcggttcactttcaaaatgaaaagcttttgtatcaagcatttacacattcatcttatgtgaatgagcatcggaaaaagccgtatgaagataatgaaaggcttgaatttttaggtgacgctgttttggaactgacgatctccagattcttatttgccaaatacccggctatgagtgaaggagatttgacgaaattgagagccgcaattgtttgcgaaccgtctctcgtttcattggctcacgagctgtcattcggcgatcttgtcctgttgggtaaaggcgaggaaatgacaggcggaagaaagcgtcctgctctattggcggatgtttttgaggcatttatcggagccttgtatcttgaccaaggattagagccggtcgaaagtttcttaaaagtttatgtgttccctaaaattaacgatggtgctttttctcatgtgatggatttcaaaagccagctgcaggaatacgtgcagcgggacggcaaaggctctctggagtacaaaatctccaacgaaaaaggacctgcgcacaaccgtgaatttgaagccatcgtatctctaaaaggtgaaccactcggagtcggaaacggccgttcaaagaaagaagccgaacagcacgctgctcaggaagctttagctaaattgcaaaaacaccatacgaaacaataaaatcccccttatgactcaggggatttcagtatgtatgccgtcttatttcaccaatgtttatgatagaattgaaatacttattacataaggaggatcgctatgttcctcaaacgtttagacgttataggatttaaatcatttgcagaacggatttccgtagacttcgttaaaggcgtgacagcagttgtcgggccgaacggaagcggaaaaagcaacatcacggatgccattcgctgggttctcggcgaacaatcggcacgctctcttcgcggcggaaaaatggaagacatcatttttgccgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccgtgccggttgaaggatattattgatttatttatggactctggccttggtaaagaagcattttctattatcagccaagggaaagtggaagagatcctgagcagcaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaaggacaggttgaacctcttaaaattcaagcttcaatagcgaaagactaccttgagaaaaagaaagagctggagcatgttgaaattgcgctgactgcctatgatatcgaagagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtagatgagctccagcaagttttactggtaactagtgaagagctggaaaagcttgaaggccgtaaagaagtcctgaaagaacgaaagaaaaacgctgtgcaaaaccaagaacagcttgaagaagccatcgttcagttccagcaaaaagaaacggttctgaaagaagagctttcgaagcaggaagctgtcttcgaaacgcttcaggctgaggtgaagcagttaagggcgcaagtaaaagaaaaacagcaggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcagagactcgcggacaacaatgaaaagcacctgcaggaacggcgtgatatttctgcgcgtaaagccgcatgtgaaacggaatttgcccgaattgagcaggagattcacagtcaagtcggtgcatatcgtgatatgcagacaaaatatgagcagaaaaagcgccaatacgaaaaaaatgaatccgctctgtatcaggcataccaatacgttcagcaagcgagagcaaaaaaggacatgcttgagacgatgcagggagatttctccggcttttatcaaggtgttaaagaagtgctgaaagcgaaagagcgccttggcggaattcgcggagcggttcttgagctgatttctacagaacagaagtatgaaacggccattgaaatagcgctcggcgcttctgctcaacacgtcgtgaccgacgatgaacagtctgcccgcaaagcgattcaatatttaaagcagaattccttcggccgggcgacgtttctgcctctttctgttattagagaccgccagcttcaaagccgtgacgcggaaacagccgcccggcattcatcatttctcggggttgccagtgaacttgtcacatttgatcctgcgtatcgaagcgtcatccagaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctccttggaagaagccgggagctagaagatgtgacgaaacggctcgctgaaatggaagagaaaacggcactgcttgaacaagaggtcaaaactcttaagcactccattcaggatatggagaaaaaactggctgacttaagagaaaccggggaaggcttaaggttaaagcagcaggatgtgaaaggccagctgtacgaacttcaagttgccgagaaaaatatcaatacccatttagagctctatgaccaagaaaaatctgctctgtcagaaagcgatgaagagagaaaagtgcgcaaacgcaagcttgaagaagagctctctgccgtatctgaaaagatgaaacagcttgaagaggacatagacagactgacaaaacaaaaacaaacgcaatcctcaacgaaagagtctctctccaacgagctgactgagctgaagatcgcagcggccaaaaaagagcaggcttgcaaggggaagaggacaaccttgccagattaaagaaagagctcactgaaacagagcttgcgttaaaagaagcaaaagaagacttaagcttcttaacgtcagagatgtcatctagcaccagcggcgaagaaaagctggaagaagcagcaaaacataaattgaatgacaaaacgaaaacgatcgaactgattgcattaaggcgcgatcagcgcatcaagcttcagcatgggcttgatacgtatgagcgtgagctgaaagaaatgaaacgcctgtataaacaaaaaacaacgctcttaaaagacgaagaagtcaaacttggacgaatggaagtcgagcttgataatttactccaatacttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaaacgctttaacgacacattcgtccaaatccgctcacactttgatcaagttttccgctccttattcggaggagggcgagctgaactgaggctcactgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtcctgtgccgttttgcgtccttgacgaagtagaggctgcgctcgacgaagcgaatgtgttccggtttgcgcagtatttaaaaaaatacagcagtgatacccagtttattgtgattacccacagaaaaggaacgatggaggaagcggatgtgctttatggcgtaaccatgcaggaatccggtgtttccaaggtaatctcagttaagctggaagaaacaaaagaattcgttcagtaacgaggaaagaggttaaaagatgagcttttttaaaaaattaaaagagaaaatcacaaaacagacagattccgtatctgaaaagtttaaggacggccttgaaaaaacaagaaactcctttcaaaacaaagtgaatgatcttgtatcccgttaccgtaaagtggatgaggatttcttcgaagagcttgaagaggttcttatcagcgctgatgtcggttttacaaccgttatggaattaatagatgagctgaaaaaagaagtcaaacgcagaaatattcaagatccaaaggaagtccagtcagtgatttctgagaaactggtcgagatttataacagtggagatgagcaaatttcagaactgaacatccaggatgggcgtttaaacgtaatccttctggtaggtgtaaacggcgtcgggaaaacaacaacgatcggaaagcttgctcataaaatgaaacaagaaggaaaatctgtcgtacttgccgccggagacacttttagagcgggggccattgaacagctggaagtgtggggagagcgtacaggagtgcctgtcattaagcagacggccggaagcgatccggcggctgtcatctacgatgctgttcatgctgcgaaagcaagaaatgccgatgtattaatttgtgatacggcaggtcgtctccaaaacaaagtaaatctcatgaaagagcttgaaaaagtgaaacgtgttatcgaaagagaagttcctgaagctccgcatgaggtgctgcttgcccttgatgccacgaccggccaaaatgcaatggctcaggcaaaagagttctctaaagcaacaaatgttaccggcattgctttaacgaagcttgacggtacggcaaaaggcggtatcgtccttgcgattcgcaacgagcttcacatcccggttaaactagtcggtttaggagaaaaagttgatgatcttcaggaatttgatccagaatcctatgtgtacggactcttttcagatttagtggaaaaagccgacgattaagaaaaaggccccaacatcttggggccttttcttttttatcttcttacttgataggcgaaatgataaaggctgttatcagtggataccagtcttgattcaccagaaaaaactctgaatgggatgatgtcatagtaatgaacggaaacagatgtgtaatacgtatagtaaccagcagctggccccaaatacattggaacctcaaatgttccgtttgcatcagtggttcctgaagcagtttgtgttgtgtttccgaccttcgtgtccgcttcaaatcttacgggcgcgtttggcactggctgtccgttttggtcgagtaatttgccgcttactgtaatattgtacttgactcgccaatattgaccttgtccgtaattgattttaccgtaaacccctccatctgtgctgatatttgtgatcgaagccttataaggtgcctcagcagcgtctgcttgctgtgccggaaaacctattgtaaacagggctgccagacataacataaacaataaaccgatttttttcataaaaatcctcctttaaatagggttcatatacaatatcggaataaattggatgatatttagcgtattttggaaaaagttaatcaccgctttgacaagataaaaacttgacagtgtcaataaaaccgtgtaaactaagttatcgtaaagggatttgacttaacaaaggggagagctcaaatgtcactcgaaaagacaacgagaatgaattatctgtttgatttttatcagtcgttgttgacgtcaaaacagaagagctatatgtcgctttattatttggacgatttctccctaggcgaaatagccgaagaatatgaggtttcaagacaagctgtttatgataacatcaaacgaacagaagcaatgcttgaacaatatgaagaaaagctgctccttttgaaaaagtttcaggagcgtaaagagatgtttaataagctgaaggagcttgcttccggttcaaaagaagaggaagaaattacagctctgattgaagcgcttgagaaattagattaggaggcggcaaactatggcatttgaaggattagccgaccgactgcagcagacgatttctaaaatccgcggaaaagggaaagtcagcgaacaagatgtaaaagatatgatgcgtgaggttcgccttgcgctgcttgaggctgacgttaactttaaagtagtcaaagattttgtcaaaaaagtaagtgaacgcgctgtaggccaagacgtcatgaaaagtctgacgcccggccagcaggtcattaaagttgttcaagaggaactgactgagctgatgggcggcgaagagagcaaaatcgccgtcgcaaaaaggccgccgactgttattatgatggtcggtctccaaggtgccggtaaaacgacaacaagcggtaagcttgcgaatctgctgcgcaaaaagcataatcgcaaaccgatgctggttgctgccgatatttaccgcccagccgcaattaagcagctggaaacactcggcaaacagcttgatatgcctgttttctctcttggcgatcaggtcagtcctgtagaaatagctaaacaggctattgagaaagccaaggaagaacattatgactatgtcattttggatacggcagggcgcttgcatatcgaccatgaactgatggatgaactgaccaacgtcaaagaaatcgcgaatccggaagaaattttcctggttgtcgattcaatgaccggtcaggacgctgtgaatgttgccaaaagctttaatgaacagctcggtttaaccggtgttgtgttaactaagctggatggagacacacgcggcggagctgcgctttctattcgcgctgtcacaaacacgccaattaagttcgcaggtttgggcgaaaagcttgatgcgttagagccgttccatcctgaacgcatggcatcaaggattctcggcatgggcgacgtgctgacattgattgaaaaagcacaggccagcgttgatgaagacaaagccaaagagctggaacaaaaaatgagaacgatgagcttcacattggacgattttctggagcagctcgggcaagtcagaaacatggggccgcttgatgagcttctgcaaatgatgccgggtgcaggtaaaatgaaaggtctgaaaaacatccaagttgatgaaaaacagctgaatcatgtggaagcaatcatcaaatcaatgactgttcttgaaaaagaacagccggatattatcaatgccagccggcggaagcggattgcaaaaggaagcgggacatccgtacaggaagtcaaccgtttgcttaagcagtttgatgaaatgaaaaaaatgatgaagcagatgacaaacatgtcaaaaggcaagaaaaaagggtttaagctaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccacgtgacggccgtttcatcgaaacagtcggaacttacaacccggttgcaaaaccagcggaagtaaaaattgacgaagagcttgctcttaaatggcttcaaactggagcgaaaccatctgatacagttcgcaacttgttctctagccaaggaatcatggaaaaattccacaacgctaaacaaggcaagtaatgactgatcaacacttggaagatttgattgtccacattgtgacgccgcttgttgatcatccagatgacattcgcgtcataagagaagaaaccgatcaaaagattgcgctgcgcttatctgtccataagtcagataccggtaaagttatcggaaagcaaggccggactgcaaaagcgattcgaacagctgtatttgcagctggcgcacagtcttctaagaaagttcaatttgaaatatttgactaaaagggagagggccggcacctcccctttttttacacgcaaaaaaagggtaaactgatagaagcttaggcaaaatagaaaagcctgggcgagaaaaagttttaaaagcggggagcttggtgcgatgcaaattattcaccgtgtagccgttatgcaagtcttaaccgagcgcagtaaagaaaagcttttagcttcttttgccgaaaagaaacaaatgcttgaacgagaatgcagccagctctattttcagcttagaaaacatgagaaagaacagcaaaaccctgatatgattgaacaatttaaaaaggcaataggaaagcgaaaagatgatataaaaatcattgattttcaaattgctcaagtacatacattgccgcttggcagtgagttgaaagaaaaggaagtcgatgcgctgctgacgattgaagccggggatgactggcatgagaaaacagcagcgaacaccatcgtcataaaagacggaaaagtaattgaaattcgccagaggtgatcatatgacaaagcgatggtttaatgtaggcaaaatcgtaaatacccacggaatcaaaggcgaagtgcgggtgatttcaaaaacagattttgccgaagaacgatacaagccgggaaacacgctgtatttgtttatggacggccgtaacgaaccagtggaggtaacggtaaacacacatagactgcataagcaatttcatctcctgcagtttaaagaaagacaaaacctaaatgaagtagaagagctgaaaaacgcaatcattaaagttcctgaagaagaattaggagagctgaatgagggtgaattttatttccacgaaattattgggtgtgaagtatttactgaagaaggcgaactcatcggaaaggtcaaagaaattttgacgcctggagccaatgacgtttgggtcatcggaagaaaaggaaaaaaagacgcactcattccttacattgaatcagtggtcaaacatatcgatgtcaaggaaaagaaaattgagattgaactcatggaagggttaatagacgaatgaaaatcgactttttgacgctgtttcccgaaatgtttgaaggcgtgctcggctcatcgattcttcaaaaagcccaggaaaaaaatgcggtgcagtttcaagtcgtaaatttccgggagtactctgataacaagcacaatactgttgatgattatccttatggcggcggggcaggcatggttctcaagccccagcctgtttttgacgcggtcgaggacctgacatcaaaggcagccgctgctccgcgtattatcctcgtatgcccgcaaggtgagcgttttacccaaaaaaaagctgaacaattagcaaaggaagagcatttgctgttcatttgcggccattatgaaggctatgatgaacgcattcgcgagcacttggtaacggatgaaatatcaattggcgactttgttctgacgggcggtgagctccctgcaatgatgatcgcagacagtgtggtcagactgcttccgggtgtacttggtaaagaggcttcccatattgaggattcattcagcaccggactcttagagcacccgcattatacaagaccggcagattacaaaggtttaaaagtgcctgaaacactcttgtcaggaaaccatgcaaaaattgaagaatggcggaataaagaatcgatcagaaggacctacctaagacgtccggatctgttgaaagactacccgcttacagagcagcaaagaaagtggatttctgaatgggaaaaagaatagattttattgcataggctatgaaattgtgataagatactacttgtggcttaagcgggcttatccgctgcaagcttgaaaacgatgttccgctgtgccggtttttgtggccaagagcatctgttggaaggagttgaaaacgatgcaaaaactaattgaagatatcacaaaagaacagcttcgtactgatcttcctgcgttccgtcctggtgacactttacgtgtacacgttaaagttgttgagggtaaccgtgagcgtatccagatctttgaaggtgttgtgattaagcgtcgtggtggtggaatcagcgaaacgttcacagttcgtaagatttcttacggtgttggcgttgaacgtactttcccagtacacacaccaaaaatcgcgaaaatcgaagttgtacgttacggtaaagtacgccgtgctaaactttactacctgcgtgaacttcgcggaaaagcggctcgtattaaagagatcagacgataatgataacgaacgaaaagagcttgttacctgtaacaagctctttttttatacagaatttgaaaatgccggacaggcatcgtaaaatacataaaggacaacaatgaatcatgcatactgaagataaaggcggtgttcgtgtcacatgacaattcaatggttcccgggccatatggcaaaagcaagaagggaagtaaccgaaaaattaaaattaatcgatatcgtatatgaattggtagatgccagaattccaatgtcatcaagaaacccaatgattgaagatattctaaaaaacaagccgcgaattatgctgttaaacaaggctgacaaagcagatgcggcagttacacagcggtggaaagagcactttgagaagcaggggatccgctctctgtctattaattctgtaaatggacaagggttaaatcaaattgtgcctgcatcaaaagagatcctccaagaaaaatttgaccggatgcgtgcgaaaggtgtgaaaccgagagcgattcgcgctttgattatcggcattccaaacgtcggaaaatcaacgctcatcaaccggcttgcaaagaaaaacatagcaaaaacgggagacagacctggcattacgacttctcaacagtgggtcaaagttgggaaagaattagagctattagatacaccggggattttgtggcctaaatttgaggatgagcttgtcggtttgagacttgcagtcactggggctattaaagactcgattatcaatttgcaggacgtggccgtgtttggtcttcgttttctcgaagaacattacccagaacggcttaaagagcgttatggccttgaggagatcccagaggacattgccgagctgtttgatgcaataggtgaaaagcggggctgtctcatgagcggtgggctcattaactacgataagacgactgaagtcatcattcgagatattcgcactgaaaagttcggcaggttgtcatttgaacagccgacgatgtaaaggcgcgcagaaatgcgggtctttatttcttcttggctgaaccgatacatacagtaagggagaagagaaagtgaatacattaaccgtaaaggacattaaagaccgtttgcaggaagtgaaggatgcacaagacccatttattgcccaatgcgaaaacgacccgagaaaaagcgttcaaacgcttgtagagcaatggcttaaaaagcaagcgaaagaaaaagcgctgaaagaacaatgggtgaatatgacttcctatgaaaggctggcaagaaacaaaggatttcgcttgattgcaggtgttgacgaggtcggccgggggcattggcaggaccagttgtcgccagcgcagtcatccttccagaggaatgtgaaatacttgggctgacagactccaaaaagctttcagagaaaaaacgcgaggaatattacgagcttattatgaaggaagcactggcggtcgggataggaattgtagaagctactgtgattgatgagatcaatatatatgaagcttcaaaaatggcaatggtgaaagcgatacaggatttgtcggatacacctgattatttgcttgttgacgcaatgacacttccgcttgatacggctcaggcgtcaattataaaaggcgatgccaaaagcgtgtctattgcggcaggtgcgtgtatcgcaaaagtgacgagggaccgaatgatgagcgcttatgccgaaacgtaccccatgtacggctttgaaaaaaataaaggctatgggacaaaagaacatttggaagctctcgctgcatacggcccaactgaattgcaccgcaaaactttcgctcctgttcaatctttcagataaatcacatggacaaggaggcacctttttaaaatgaacatacgaaatgatgtgcaaaaggcgctgcagcacctttttgggcgtacagccgtcccgcaggaaacatcaaaagtaaacgaagcgctaaacggggagaagcgtctcctcttaggaaaagtgcttcgcttactaggagatcagcatgccctgatccaagtcggcaatcaaactgttcagggaaaacttgaagcccagcttcgtcctcaggcatactattggttttcctacgaaaaaaaaacggcagaacaaacaggccgtcttcaggtcgttcaaagctttgaccaaaatcctaaaaccattcaggatgcagctggcaagcttttaaatgccatatcagtgaagacgtcaaacgcagctctcatgatgacaggagcgatgctgaagagcaaaacacccgtaacagaaaatgatatcaaaacagccgtccgctggatggacacgctgccttcgcaagacacaaaaaaagcagttgaaacggttctcttcgctttaaagcgtgatcttcccattcactccgagattttgaatggtgttcacgctgtgaaatcgcctgttccgttgcatcagcacgtatcccagctgcttcaggcaatcgaccaaaaccctcagcagagccaaatgatgtcaaagctaaaggaagcagttacggtgcttttaaatagtgaaatcgatgtccatgcagaacggctgattgataagcttatttctttaaccgacaatacgaaagcaccttctccggcgaatacagctggaagcagggagcttagcacaccagttggctccccggaaaagcaagcttgccggttgcaaatcacacagcagaacagagaagcatacaagaagagtctgttaaaacagcagcagacattccaattaaagaagcccgccagctgctgatgaagctgacggaatctgctgaaaaaaacagtctccaaattgtgaaagaagcagcaaattggattaaagcggctgcttcatcgggtgatagtaagtcacttgcagcttcagctgttttacaggcagcacaagtcacagaccaggaagccgaagtctttttaaaggctgttcagcagacagcaccccatttggcggataaggcagatgttctttctttcttatccaaagtgaaaacggcaatcggcgcaagggacgaggttgcgttcattaaagcgtttgaacaaggaagcgcagtcacatctggcgaaatgcaatccatcaagctggctctttctgccttaagagcatcgcatgaggtagccgaaccagtcaaacaagaagccgatcagctttttcataaattaaatggccagcttttcatgcagcatgaccatccgtcatacagccaaattgtaatgtcatttccgatgttttcgaagtcaggggttcaggacatgactgttctgtttaaaggaaagaaaggagcggatggaaagcttgatacttcccattgccgccttttgtttttgctgcagcttgatacactaaaagaaaccgtcgttgattgcttggtacagcaaaaagtcatgaccattacaatagagactgatttcgagctgcaggctgcgatcgatccgatggtgcccgcgcttaaacaggggctaaaggaaatggggtacagcctttcaggggtaaacgctaaaaaaagggttcacaccgaagaaaaggcttcaatcgatcaatatataacaagtatcagtgatcaggaagtggatgtgaaaatatgaaagagcagacaccgatcagaaaagctgttgctctccattatgacgaacaaaaagacaaggcgccgagagtgattgccacaggaaagggccatgtagctgacaacattatcaaagaagcaaaaaaagcaggggtcccgattcaagaagatcggactcttgtcgaattaatgcgccatttgacggtagatgatcaaattcctgaagctctttatgaaacggtagccgagattttttcattcatttacaaattggacgaaagcgtaaaaaacaaaaaatagctaaaatattccccatcctcctttgaaatttatgtttttaataaagtaaaagtttgaatgtttagaaggattaaaagattttgcatcgaactgtagacaattcttccagtaatattatagaatgaaagcgcagtctattttagttttgttacataagttaggaggatgggaaatgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttgatggcttctgaagaaggcggaacggaaattgaagaagttgcggagaaaacaccggaaaaaatcaaaaaagctgtcattgatccggctgtcggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgttaccggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcggggcttgcaatgtccacgatggatattatcaagcattatggaggagaaccggccaacttccttgatgtgggcggcggtgcaaccgcggaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtagatctagggaagaaaatccttagtgaatcaggattaaacattacatctgcggaatcaatggctgacggcgcgcagaaaatcgtatccttagtttaagaaagaatgaaaggcaggggaccaaataatgagtgttttcattaataaagatacaagagttattgtgcaagggattacaggttctaccgctttatttcatacgaagcagatgctcgaatacggcacaaatatcgttggcggtgtaacacctggaaaaggcggaacagaagtggaaggtgttcctgtatttaatacagtggctgaagcagttcaaacgaccggcgctaacgcgtctgttatatatgtgcccgcaccgtttgcagctgatgcgattatggaagcggtagatgcggagcttgatctcgtgatttgtatcacagaacatatcccggttttggatatggtgaaggtcaaacgcttcatggaaggtaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcagtgcaccagctctcagaagcgggtgtagggcaatctacagctgttggaatcggcggcgaccctgtaaatggaacaaactttattgacgttttaaaagcgtttaacgaagatcctgacacacacgcagtcatcatgattggcgaaatcggcggtactgccgaagaggaagcggcagagtgggtaaaagccaacatgacaaaaccggtagtcggttttatcggcggtaaaacagcacctcctgggaagcgcatggggcatgcaggcgccattatttccggcggaaaagggacagctgatgaaaaaatcaaaaccctcaatgcatgcggaatcgaagttgcagagacaccttctgtcatgggtgaaaccttaattaaggtgctgaaagagaagaacttgttcgaaacttgtaaaacgcattaataaaaaagggacagccgtcaaggctgttcctgctttttctaacaaaaggaggtcaatctattggatcaggccgctgcctgcctaacgatttgcagaatcaatcaattattatccccatcccttctattaaaatggtggaaagccgatccgtctatgtcgctgacatcacccgtgttacaaacggttactcgtgatcaaataaaagcagctgcattaaaaaacgaaatagaacaactttatccaaagctccagcgtgtacttgctgcttatcgtgagcaaggcattaacaccatccctatttcttcaaagcaatatcctttctggcttaaaagcatttatgatcccccgccgtactgtttgcaaaaggtgatatgactcttctttcgaaagggagaaaaattggaattgtagggacaagaaatccaacagcttatgggaaacaagttgtcaatcatcttacaaaagtgatctgtcgtaaaggttgggtgattgtcagcggactggcgtctgggatagacggaatgtcccatgctgcaagtattaaggcgaaggggcggacaattggcgtcattgcaggcggatttcagcacatttatccccgagaaaaccttcagttagcagatcacatggctaaacaccatatcctgctgtcagagcacccacctgaaactaaaccccaaaaatggcatttccctatgagaaaccgtattatcagcggactaagtgaaggcgttattgtcgttcagggcaaagaaaaaagcggttcactgattactgcctatcaagcattggaacaagggagagaggtatttgccgtacccggttcattatttgacccttacgccggaggtcctataaaactgatccagcagggggctaaagccatatggtcagcagaggatattttcgaggaacttcctgagagaaacgttcaatatacggaacccttttgaattatcgtttgacaaacggtattgtaatatttaataatagtgaggatttaaagttgcatattgttttctatttaattaatgacgttcatgataaagaatgaaatgttgaaagccaaataaagacagctgcaaaaataaaattgaaatatcttgaaaagagagagaacacctcttgagggggatgaaaatgtctgattatctagtcatcgtggaatcgcccgctaaggcgaaaacgattgaacgttacttaggtaaaaaatataaagtaaaagcatcaatgggacatgtccgggatcttccaaaaagtcaaatgggagttgacatagaacagaattttgaaccgaaatatattaccattcgaggtaaaggcccggtattaaaagagctgaaaacggctgcgaaaaaagccaaaaaagtgtatctcgcagccgaccccgacagagaaggggaagcgattgcatggcatttggcacacagtcttgatttagatctcaactcagactgccgtgtggtgtttaacgaaattacaaaagacgctattaaggaatcgtttaagcatccccgcatgatcaatatggatttagtggatgcacagcaagcgagacgtattttagacagacttgtcggatataaaatcagtccaatcttatggaaaaaagtcaaaaaagggcttagcgcaggacgcgtgcaatccgttgccctccgtttgattattgaccgtgaaaaagagattaacgactttaagcctgaggaatattggacaattgacggtacgttcttaaaaggtcaagaaacctttgaagcgagctttttcgggaaaaacggcaaaaaacttcctttaaatagtgaagccgatgtaaaagagattctttctcagctcaaagggaatcaatatacagttgaaaaagtaaccaaaaaggaacgcaaacgtaatcctgctttgccttttaccacttctaccctgcagcaggaagcggctcgcaagctcaatttcagagcgaagaaaacgatgatgattgcacagcaattatatgaaggaattgatttaggaagagaaggaacggttggtctgatcacgtatatgagaacggattcaacccgtatttcaaatacggctgttgatgaagcagctgcatttattgatcagacttatggaaaagagttcctaggcggaaaacggaagcctgcgaaaaagaatgaaaatgcccaggatgcccacgaagcaattcggccgacatcagttcttagaaaaccaagtgaattaaaagcagtcctcggcagagaccaaatgagactgtataaattaatttgggagcgttttgttgccagccaaatggcaccggctgttctcgatacaatgagtgtcgacctgacaaacaacggtttgacatttcgtgcaaatggaagtaaagtcaagttttccgggtttatgaaggtgtatgttgaaggaaaagacgatcaaatggaagaaaaagaccggatgctgcctgacttacaagaaggcgacacggtattatcaaaagatatagaacctgagcagcattttacccagccgcctccgcgatatactgaggcccggcttgttaaaacccttgaagaacgcggtatcggccgtccatccacatatgctccgacacttgatactattcagcggcgcggctacgtggcattggataataaacgtttcgttccgactgaattaggtcagatcgttcttgacttgatcatggagtttttccctgagatcattaacgttgagtttacagctaaaatggagagagatcttgatcatgttgaagaaggaaataccgaatgggtcaagattatcgataatttctacaccgattttgaaaaacgcgtcaaaaaagccgaatcggaaatgaaggaagttgagattgaaccagagtatgctggagaggattgtgaattgtgcagttctccaatggtatataaaatgggacgatacggtaaattcttagcttgctccaacttccctgactgccggaacacgaaaccgattgtgaaacaaatcggtgtgaagtgcccgagctgcggagaaggaaacattgttgagcgaaaatcgaaaaagaaacgggtgttttacggctgtgaccgttatccggactgtgaattcgtatcatgggacaaaccaattgaacgaaaatgccctaaatgcggaaaaatgctcgtcgagaaaaaactcaaaaaaggcatacaagtccaatgcgtggaatgcgattataaggaagaaccacagaagtagcggtgagcagggtcttgctcaccttctttgtgtgttaaaagaaggccttgaataataaactaggagatgtgaaagatgaaccaacaaacagtgaatgtaatcggagccggactcgcaggaagtgaagcagcatggcagcttgccaaacgggggattcaagtcaaattgtatgaaatgcggccagttaaacaaacgcctgcgcaccatacagataaatttgcagagcttgtctgcagcaattctcttcgctctaatacacttgctaacgctgtcggtgtattaaaggaagaaatgcgtgcgcttgattcagccattatcgctgcggctgacgaatgttcggtgcctgccgggggcgctcttgcagtagaccgtcatgaatttgccgcaagtgtgacaaatcgggtgaaaaatcatccaaacgtaaccgttattaatgaagaagtgactgaaattcctgaaggccctactatcatcgcaacgggtccgttaacatctgaatcgctgtctgcccagctgaaggagttgactggagaggactatttatatttttatgacgcagcggcgccaattgtagaaaaagacagccttgatatggataaagtgtacctgaaatcccgttatgataaaggtgaagcagcatatttgaactgcccgatgacagaagaagagtttgaccgttttcatgaagcattaacatcagcagaaacagtgccgttaaaagaatttgaaaaagagattttctttgaaggctgcatgccgattgaagtcatggcaaaacggggtaagaaaacaatgcttttcggtccgatgaaaccggttggtctagagcatcctgttacaggaaaacgcccttatgccgtcgttcagctcagacaggatgatgctgcgggaacactttataatattgtaggattccagactcatttaaaatggggagaccaaaaggaagttctcaagttgattccaggacttgaaaatgtagaaatcgtcagatatggcgtgatgcacagaaacacatttattaactctccaagcctgttaaagccgacttatcaatttaaaaaccgcagtgatctgttctttgcaggccaaatgacgggagtagaaggatatgtggaatcagctgcctcaggacttgtagcaggcattaatgcggcgaagcttgtattgggagaagagcttgtgatcttccctcaggaaacagcaattggcagtatggcacattatattacaacaacaaaccagaagaacttccagccgatgaatgcaaactttgggcttttaaaagaattgccagttaaaattaaaaataaaaaagaacgaaatgaacaatacgcgaaccgtgcgattgaaacaattcaaacaatttcgaaaacaatataggtattgattgcaacctgagcgcgatttgtgataccatttaaaagcccttcctggggaggtattaggcatggagaatgttaagaatttcgtaaagttattcgttgaatatttacaaattgaaaaaaattattcacaatatactattgtgaattatgtggattcaattgaagaattcgagactttcctgcgcgttcaaggtataaatggatttgaagaagctgcatatcaagatactaggatttttttgacagaagcctatgaaaaaggtttatcgagaagaacaataagcaaaaagatatctgcattaagaagcttttataagtttctgatacgggaaaagcttattgaagaaaatccgtttcagcttgttcatctgccaaaacaggagaaacggataccgaagtttctatatcaaaaagagcttgaggagctgtttgaagtttcagatataagccagccggccggaatgagggatcaagcgctgttagagctgctctatgccaccggaatgagggtcagtgaatgctgttccataactattaacgacgttgatttatttatggacactgtgcttgttcacggtaaaggcaagaagcagcgctatatcccctttgggtcttatgcccgcgaagcgttgaaggtatacatgaatagcggaagacagtgcttgctgatgaaggcaaaagaacctcatgatctattattcgtaaatcaaagaggcggaccgcttacagcccgtggcatcagacatattttaagcgggcttgttcaaaaagcgtcaagcactttacatatccatccgcatatgcttcgacatacgttcgccacgcatctgttaaatgaaggagcggatttgagaagcgttcaagaactgctcgggcattccaatctgtcttctacacagatatacacgcacgtttcgaaggaaatgttgagaaacacatatatgtctcaccatccaagagcatttaagaaaaattaaaggaggccctttatgtcatcttttcatgcgaccacaatatttgccgtacagcataaaggacgaagcgctatgtccggagacggccaagtaacatttggtcaggctgttgtcatgaaacacacggcacggaaagtgagaaaactgtttaacggcaaagttcttgctggctttgcgggatctgttgcagacgctttcactttattcgaaaagtttgaagctaagcttgaagaatataacggcaacttaaaacgggcggctgttgagcttgcgaaggaatggcgcagcgataaagtgctaagaaagctcgaagccatgctgattgttatgaatcaggatactttgcttctcgtatcgggaacaggcgaggtgatcgaaccagatgacggcattctcgcgattggatcaggaggcaattacgctttggcagcgggaagagcattgaaaaagcatgccggtgaaagcatgtctgcaagtgagattgccagagccgcgttagaaacagcaggcgaaatttgtgtttacacgaacgatcaaatcatactggaagagcttgaatagaaaggacttgaggcgcatggaaaaaaaaccgttaactcctagacagattgtagatcggttagaccaatatattgtcggtcagcaaaatgcgaaaaaagctgtcgccgtggcattaagaaaccgctatagaagaagtcttctggatgaaaagctgaaggacgaggtcgttccgaaaaacattttaatgatgggtcctaccggcgtcgggaaaactgaaattgccagacgaatcgctaagctttcaggtgcgccatttatcaaaattgaagctactaaatttaccgaagtcggctatgtaggcagagatgttgaatcaatggtcagagatcttgtggagacttctgttcggcttataaaagaagagaaaatgaatgaagtaaaggaacaggcagaagaaaatgcaaacaaacgcattgttcgtctgttagttcccgggaagaaaaaacaatctggcgttaaaaatccgtttgaaatgttttttggaggcagccagccgaatggtgaagatgaggcggagagccaggaagaagcaaacatcgaagaaaaaagaaaacgaatggcgcatcagctggctttaggagagctcgaagactactatgtaacagtagaagtcgaagagcagcagccttctatgtttgacatgctgcagggctcgggtatggagcagatgggtatgaacatgcaggatgcgctgagcggattaatgccaaagaaaaagaaacggcgcaaaatgacagtcagagaagccagaaaagtcctgacgaatgaagaagcaagcaaactcatcgatatggatgaagtcggccaggaagctgttcagagagcagaagagagcgggattatctttattgatgagattgataaaatcgcaaagaacggcggtgcatcttcttctgccgatgtttcaagagaaggcgttcagcgggatatcctgccgattgttgagggttcaaccgttgttacaaaatatggttctgtaaaaacagaccatgtattatttattgcagcaggagcgtttcatatggccaaaccgtctgatttgattcctgagctgcaggggcgtttcccaattcgtgtagaactgaacaaactcacggtagacgacttcgtgagaattttggttgagccggataatgcgctgctgaaacaatatcaggcattattgcagacagaaggtatatctcttgaattttctgacgaagctattcataagattgctgaagttgcttatcatgtgaaccaggacacagataatatcggtgcgagacgccttcatacaatacttgaacgcctattagaagatttgtcgtttgaagctccagatgtaacgatggagaaaataacgattacaccacagtatgtcgaagaaaagctcggaacgatagccaaaaacaaagatttaagtcaatttatattgtgaaaaatttaatatgaggaatgtttaggaggattatttatcatggctttattacaaaaaacaagaattattaactccatgctgcaagctgcggcagggaaaccggtaaacttcaaggaaatggcggagacgctgcgggatgtaattgattccaatattttcgttgtaagccgcagagggaaactccttgggtattctattaaccagcaaattgaaaatgatcgtatgaaaaaaatgcttgaggatcgtcaattccctgaagaatatacgaaaaatctgtttaatgtccctgaaacatcttctaacttggatattaatagtgaatatactgctttccctgttgagaacagagacctgtttcaagctggtttaacaacaattgtgccgatcatcggaggcggggaaagattaggaacacttattctttcacgtttacaagatcaattcaatgacgatgacttaattctagctgaatacggcgcaacagttgtcggaatggaaatcctaagagaaaaagcggaagaaattgaagaggaagcaagaagcaaagctgtcgtacaaatggctatcagctcgctttcttacagtgagcttgaagcaattgagcacatttttgaggagcttgacggaaatgaaggtcttcttgttgcaagtaaaattgctgaccgtgtcggcattacccgttctgttattgtgaacgcactcagaaagctggagagcgccggtgttatcgagtctagatcattaggaatgaaaggtacttatatcaaggtactaaacaacaaattcctaattgaattagaaaatctaaaatctcattaatcacaaaaagaaccctttttgagggttctttttttatttcaaataaaggaaatcaataagctttatttcctgggttgaaagtctttctatgtaataattttaataaattttgcatttttcttcaaaaagtttcaaaaatgccgaaaagaaaggagaaaaaacagaaattctgctattttcaggcttatatcaaggcgagaaatgtagttctaacaatctaggactttatacccagttacaaaatagataattgtgaggacatttttttacacgaacttcatagactttatgcctgttatttcttacaataagcatatagttttacaattctcgacaaggatattgagggtgaaaaaaactgaaatggaggtaagtggatttgagcttattttctggaacgatacaaaatcttgaaaatgccttgagcagagcggatattaagcaaaaagtcataactaataatatcgccaatatagatacaccgaactataaggcaaaaaaagtctctttccaaaatttattagatcaagaatcctcgcgtcttgaagcgataaaaacagactatcgtcatgttgatttttctgatactgattcgaattattcaattgttgcgagcggagatacatcgtatcagcaaaacggaaacaatgttgatgttgacaaagagatgacagaattggcgcaaaatcaaatcaactatcaagctttggttgaaagaatgaacggtaaatttaattcgctgaagaccgtattaacaggaggaaaatgatgacagcttttcatagcttaaatgtttcagcatcggctttaacagctcagcgagtcagaatggacgttgtatcatctaacttagcaaatatggatacgacaagagctaagcaggtgaatggagagtgggtgccttacagaagaaaaatggtctcccttcagtcaaaaggtgaatcgttctcttccattctcaattctcaaatgagcggaagcgggaatgctggaaacggtgtgaaggtttcaaaaattacagaggatgattcggattttaatcttgtctatgatccgacagaccctgatgcaaacgctgatggatatgtacaaaagcctaatgttgatccattaaaggaaatggttgatcttgtcagcagcaccagatcatatgaggcgaatgtcacggcgatgaatgccacaaagggaatgctgatgaaggcgttagaaatcggaaagtaggtgaatgaatgtgattaatgcaatttctccttttcaggttcaaaatactcaaaacactcaaaatgcaacaaatcaagtaaacaatagccaaaaaacagattcttcaaatcaaacaagcttttcggagcttttaaaaaactctattagttcgttaaatgagtcccaagtagcttctgacaacatgactaatgccttggctgcaggaaaagatgtaaatcttgatgaggtcatgatcgctgctcaaaaagctagcatctctctaactgcagcaacagagttccgcaataaagctgtggaagcttatcaggagattatgagaatgcaaatgtagggggtctgacgatttagagaaagagtggaatgaccggggttaacatgaatcgtactctaatgcaaatgaaaaacaaaacgagtgagttttggaaaaatagatctaaattacaaaagattttaatggttagtgctttagcggcaattattattattggaattattattagtgtttttgcttcaaattctaaaatggcgccgctgtacaaagatttgtctgccgaagaagcaggacaaatcaaagaagaattggatgcaaaaaaagtgccaaacgaactttcgaatggcggtacagtgattagtgttccggaggatcaggttgattctttgaaagtgcagatggctgcagaaggacttcctaaaaccggatcaattgattattcattttttggacagaatgccggctttggtttgacagacaatgagtttgatatggtgaaagtaaaagctacacagacagaactgtcaaacttgatcaatgaaatggacggtattaaaagttcaaaagtaatgattaatctcccgaaagacgcggtgtttatcggtgaagagcaatctgcagcatctgcatcaatcgttttgcagattcaaccgggttatacacttgatcaaagccagatcaacggattatatcatctggtatctaaaagcgtgccgaacctaaaagaagataacatcgtcatcatggatcaaaattctacatactacgacaaatcagacagtgatgcagggtcctacgcggatagttattcttctcagcaaggaattaagtctcaagttgaaaaagacattcaaaaacatgtacagtcacttcttggtacgatgatgggccaagataaagtcgttgtctccgttacagcagacattgatttcacaaaagaaaatcggacagaagacattgtcgaacctgtggataaagaaaacatggaaggcattgcagtcagcgctgaaaaggtatctgaaacatatcagggcgacggtgcagccaacggcggaactgccggaaccggcgaggaagatgtaacaaattataaggctgacggtgaaaataccgaaagcgggaactacgaaaaaaacagcaacaaaatcaattacgaggttaaccgaattcataaagaaatcgctgaaagtccttataaggtcagagatttagggattcaagtaatggtagagccgcctgatgccaaaaacacagcgtcgctatcaactgaaagacaggatgatatacaaaaaatcctttcaactgtagtcagaacatctttggataaagatgaaacgcaaaaccagaatttatctgatgctgatatcaataataagattgttgtctccgtacagccattcgacggaaaagtcaatttggatacaaatacggaaaaatcctcaggtatcccgctgtgggcatatattgtaggcggtgttttaatcgcagcgatcattgttctgatcattatgcttatcagaaagaaacgggcgcaagaggatgaatttgaggaatatgagtatgaggttcctcaagaaccaatcaatttgcctgatatcaacgaagaggaaaatgaaacagcggaatcagtcagacgaaaacagcttgaaaagatggcgaaagacaagccggaagattttgcaaaactgctgagaagctggctggccgaggattaggaggaattagaaatggcgagacgtgatcaagataagcttacaggaaaacaaaaagcagccattctcatgatttccttggggttagatgtgtcagcttctgtctataagcacttaaccgatgaagaaattgaaaggcttactctggaaatatcaggtgttcgaagcgtcgatcatcaaaaaaaggatgaaatcatagaagaatttcataatatagccattgcgcaagattatatttctcaaggcggtttaagctatgcaagacaagttctggaaaaggcgcttggagaggataaggcggagaacattctaaacaggctgacttcttctttgcaggttaaaccatttgattttgccagaaaagcggagccagaacaaattttgaattttatccagcaagagcatccgcagacgatggcgttaatcttgtcttatttagatccagtgcaggccgggcaaattttatccgagctgaaccctgaagtgcaggctgaggttgcgagaagaatcgcggtcatggatagaacgtctccagaaataattaacgaggtagaacggattctggaacaaaaattatcttctgcatttactcaggattatacacaaacaggcggaattgaagctgttgtggaagtgttaaacggggtagacagagggacagagaagacgatcttggattcattggaaattcaggatcccgatcttgctgaagagattaaaaagcggatgtttgtcttcgaagatattgtcacacttgataaccgtgcaattcagagagtcattcgcgatgttgagaacgacgatttgctcctttcattaaaggttgcaagcgaggaagtcaaagaaattgtgttcaacaatatgtcacagcgtatggttgaaaccttcaaagaagaaatggaatttatgggccctgtacgcttgaaagatgtagaagaagcacaatcgagaattgtaagcatcgtcagaaagcttgaagaagccggtgaaattgtgatagcaagaggcggaggggatgatattattgtctaatatcattaaacaagaatcatctatttctccacaaaaggaaaaaagaaaactttctatacaagaggtgcgtattgatcattctcaccttttgcaggctgaagagaacccggaggcgcttatggcccgagtgaaagaggaagctgaccggatttctgagcaggcaaacagtcatatagaaaatattcgccgtcaaattgagcaggagaaaaacgattgggcggctgaaaaacagaagcttattgaagaagcaaaaaccgagggctttgaacaaggagtagcgctgggcaaagctgaggcaatgaaacagtatgccgaactgatcggccaagcaaacagtataactgaaatgtccagaaaagctgttgaggacaagcttgaagacgctaatgaagaaatcgttgagcttgccgttgccctagcaaaaaaagtttggcagcaaaagtctgatgataaagaggcttttctcctgcttgtacaacaggttataaacgaagtgaaggaatatgacgatatatcaatttatgttgatccatattactatgagacaatctttcagcaaaaagatgaaatccagcagcttctttataaagaatgccggcttggcatatatgctgatgaaaaagctcaaaaaggaacctgttatattgaaactccttttggcagggtagatgcgagtgttgacacacaattgatgcaattgaaagataaacttctgacagcgctggaagcaggtgcagctgaatgaagacacagagtctgatagattgtatagaaatgacagactcgtataaacggtacggaaaagtcaagcgggtaatcggcctgatgattgaatcaaaagggccagcaagctcaattggcgacgtgtgcctgatttatgcaaaaggacaatctgggaaagtcattaaagctgaggtagtcggcttccaggaagaaaatattttgcttatgccttatttagaggctgcgagcattgcacctggcagcattgtagaagctactggggaatcacttcgggttaaagttggaaccggactgatcggacaagtcatcgatgcttttggagaaccccttgacggaaagcttctgccgaaagggctttcgcctgtatcaacggagcaatcaccgcccaacccgatgaaacggccgcctatccgtgaaaagatgggtgttggagtcagatcaattgacagcttgctgacagtcggtaaaggccagcggattggaatttttgcaggaagcggtgtcggaaaaagcaccttaatggggatgatcgccaagcagacagaggctgacttaaacgtcattgcacttgtcggagaacgcggacgagaggttcgggagtttattgaaaaagatctggggaaagaggggctgaaacgatcgattgtagtcgttgccacctcagaccagccagcattaatgagattgaaagcggcatatacagcgactgccattgccgagtatttccgagataaaggccaaaatgtcatgtttatgatggattctgttacaagggtggcaatggcgcagcgagagattggactggctgctggggagcctccgacgacaaaaggctatacaccttcagtgttcgctattttacctcgtttactagaacgaacgggtgcaaacgagcatggaaccattacggcattttatacagtgttggtagacggggatgacatgaatgagccgattgccgataccgtacgcggaattttagatggacatattgtgttggacagggcgcttgccaataaaggccagtttcctgcagttaacgtactaaaaagcatcagcagggtgatgtcaaacatttcaacaaaacagcatctggatgcggcaaataaattccgtgaacttttatcgacatatcaaaattcggaagatctcattaatatcggagcttacaaaagaggatcatccagagaaattgatgaagcgatacaattttatccgcagcttattcaatttttaaagcagggaacagacgaaccggctttattggaagaaagcattgctgcattaactagtttgacaggaaatgaggaataaacgtggcttatcaatttagattccaaaagctgctggaactaaaagaaaatgaaaaagaccaatccttatccgagtatcagcaatcagtttctgaatttgaaaacgttgctgaaaaattatatgagaatatgagcaaaaaagaattgctggaacaaaataaggaaaagaaattaaaaagcggcatgagtgtacaggaaatgaggcactaccaacaatttgtctcaaatcttgataatacgatctatcactatcaaaagcttgtcattatgaaaagaaatcaaatgaatcaaaaacaagaaattttgacagagaaaaacattgaagtgaaaaagtttgaaaaaatgcgtgaaaaacagtttaaaatgtttgctcttgaagataaagctgcagaaatgaaagaaatggacgatatttcgattaagcagtttatgattcaaggccattaggagcgaatgtaatgtccggcaaaaagaaagaatcaggtaagttccgttcggttttgcttatcattatcctcccgctgatgtttctattaatcgcagggggattgttctttgggctgctggtatcaatgtcttaaagccgatacaggatgctgcggcaaaaacgccggttcttaaagaattggtccctgaaaccgaaaataaaaaaggcgcagcatcaagtaaggatagcagtaatacggcagctctggaaaagaccattaaggatcaaaaaagtgaaatcagtatattgaataaagatttagaaacaagcaaatcagaaatcgacaggctcaatcaaaagatccgttcacttgaaaagacggctgaggatcaaaaaaagtcatcagaagatcatactgaaggatcagcagactcgaaagcttcttctgaaaatgacaaagtgatcagtgtgtacaaaagcatggacagcggaaaggctgctaaaattattgcccaattaaaggagcaagaagcactgaaaatattgaatggcctaagcaaaaagcagcttgctgacatattggcgaaaatgactcctgagcaagcagcaacctatacagaaaaaattgctgccagccaagaatagggggaatgaaaggtgaagctgcttgaattagccggacctttactgcaaaccacaacgggttctgccgctaaaaacatgaaaagtagccagggagtttttcaaaactggcttatgtctgagactggattgaaggaactttcagaacaaggaaagggaacttctaattccgaagatcagcttttagcagatgcgcttaaaaagatcggtgaatggctaaatgcaagtcctgaagttcaagacaaacaaaatgcggatcttttgcaaacattaagcaaactgacagggaagcaattggatgcgaatgctctgcaaatgttgcaaaatcttttgcaagcagttgaatcaaaaatgtcaggcgggacggatcaattgctcacagaaacggagaaaattttttcagaagctaaaacggctctgagtgccaatgattctgcttctgacattaatggagcactgaagtctgatacagagcaatcaaatcaggaaaatgaagtatccgaggctgctaaagagctcatctatatccagatgttcattagccagctcgtagaagggaataagctgactgatcgcgggaatggcaatgaagctcatgccatttaccaaaatggagatcaattcctttctgcattagaaaagaagggtgtatctcaacaactaattcaggatcttaaacagcaaatattcactaaagctgagtcaagttcaaaacttcactcgatgacagcgtcagagctgaaaagctttcaaagcttaatggatcaaatgtctatgcttcctcaaaaagggaccaaagaatggagtttagctgaaagccagctgaaagccttcttgttatcgaaatcatccgaatcatcacaagactttgggaagcgtgttctcacaccgctctcgcagagttcatccagcacaaatgcatcggatgtttctggaagtattcagcctatagatagtaaatcaggactccaaatgctgttttcggggtatcggagcataggaggagttcaaacacttgatctgcagcagatgtcatctgatataccaaatgccgaaacaaaaacggtggctgatcaagtgattaatgcgtggaagcagatgaaatatacgcctttcggcagatcgacgggaagtttcactattcggctgaaccctgaacatttaggatttgtcacaatcaagctgacaaatgaaaatggaatgtttcagagtaaaatcatagcatctagccaatcagcaaaagaattgcttgaacagcatcttcctcagctgaagcaatcattgccgaatatggccgtccaaattgaccgttttactcttccggtccaaagcggggatcagccgatatacggccagcttgctgatgaacagaaacagcagcaagaggggcagagacagcaaagacagaaaaagcaatcaaatgattttggcgatctgctcgatgaagtgtcgatggttgaaatggaggaagaagaatgacttctataagttcagaatataaactgcctgaaaaaacgaacactgtgtcgacgaacaacagcagcttggggaaagacgagtttttaaaaatattaatgactcaagttcaaaaccaagatccgcttaacccggttgacgataaagaatttatcagccagatggcgactttttcaagcttggagcaaatgatgaatctgaatacgacaatgactcaattcgttgaaaaccaagatccgtttacaacgtatgttgattggatgggaaaagaagtatcttggactgatggcaaaagtgcaacagataaaacaggcacagtaagctctgttaaacattttaaaggaaattattatctcgttcttgatgatgggaccgagatcagtcctgcgaatgtcatgtctgtgggacaatcatctaaataaaaacatctgggggaatatattatgttacgttcactttattctggaatcagcggtatgaaaaactttcaaacaaagcttgacgtaatcggcaataacattgccaacgtaaatacagtaggattcaaaaagagccgggttacctttaaagatatggtaagccaaacgattgccggcggttctgctgctggtgcaacaatcggcggaacaaactctaagcaaatcggtttaggttcatcatctggcacaattgatacaattcattcaacaagcgcgacacaaagcacaggaagaacacttgatttagcaattgacggcgacggttacttccgaattgatacaggtgacgggacagcttatacaagagcagggaacttctatttagataataccggaacattggttacaggtgatggctaccatgtactaaatatgaatggcggaacaattaaaattcctactgatgcacaaagtttcactatcggttctgatggcaaggtatcgatcgttgatgccggtggtcaatcacaagacggcggacaaatcgggattgtgacttttgccaacagtgacggattggataaaatcgggagcaacttataccgtgaatctttaaactctggtacggccagtgcagcgaaccagcccggtgatggcggaacaggttcccttaaagtaggatttctcgaaatgtctaacgtcgatttaactgacgaatttactgaaatgatcgtagcccagcgcggattccaatcaaactcaaaaattattacaacatctgatgaaatccttcaagaactggttaaccttaaacgttaaggagggaggggaggcgagtaatcgcttctccgctgttttatgattaaagtaacccgtttgaacgggcagccctttacactgaatgcgctatttattgaacagattgaatgttttccggatactacaattactctgtcaaatggtaagaagtttgtagtaaaagaagatgaagaagctgttctggaaaagatcgcagctttctaccgaaaaatacaaatatttgcaatggatcaaggaatagaggaaccggaatgaagaaaaagttaatgatcatattactaattattcttatcgtaattggtgctctcggggcggcggcttattttgttttaggcggaaagtccgaaaaaagtgaagcgaaaaaaagtattgatgaaatcgttgcgtcttctgttgatgtagaagagatcacaacaaatttaaagtctgataacattatccgtcttgctattaaacttgaaactgattctgataaatcaaaagaagaacttgagaaacgtgatttccaagtgaaagacgctgttatatcactgctggctgatacgaatgctgatcagattgagggagacaagggaaaagaaacctttaagaaggaactaaaagataaaataaatagctacctccaagaaggaaaagtagaaaaagtgtatattacctcctttaatctgcaataaagcataatttgacagaatacggaggtgaggaaaatgtcaggagaagttctctcccaaaatgaaatagatgcactgctttctgcaatatcaactggtgaaatggacgctgaagagctgaaaaaagaagaaaaagagaagaaagtcaaggtttatgatttcaaacgtgcgctgcggttttctaaggatcagattcgcagtttaacgagaattcatgacaattttgcaagacttcttaccactcatttttctgctcagctcagaacctatattcacatatctgtcagttctgttgatcaggttccgtatgaggaatttatcagatcgattccaaacatgacgattctaaatctatttgatgttcatccgatggaaggaagaattatgatggaggtcaaccccacgatagcttatacgatgatggatcgagtcatgggcgggattggaatcagtcataacaaggttgacagtttgacagaaattgaaacaaaaatcatttctaatttatttgaaaatgcactgggtaattataaagaagcttggcagtcaattgctgatattgaaccggaaatgactgagtttgaagtgaatccgcaatttgttcagatggtatctcctaatgaaacagtcgtggtgatctcgctcaatactcaaattggtgaaatcagcggtgtcattaatctctgtatcccgcatattgtactcgagccgctcataccgaagctttcagtccactattggatgcaatcagaccgaaatgagccaaagcctgaggaaacaaagtcgcttgaaaaacgtatcatgacagcacaaatacctgtcgtggccgagctcggcacatctgaactgacgatagaagagtttttaagtttagaagtcggagactgcataactttggacaaatcagtcacggatcctcttactgtattggtcggagataagccgaaatttttaggacaagccggccgggtgaatcgaaaacaggcagtgcaaattttagatcacgacataagaggtgaacaagatggagaataatagattatctcaagatgagattgacgcgcttcttaacggtactggcagcacgcttgatgagccagaggttccggaagtagatgacttatcggaaatggagcgtgatgcgatcggtgaaatcggtaatatttcattcggcagttctgcgacagcactgtcaacgcttttaaatcaaaaggtcgatattacgactccaagcgtaacggtcattccaagaagtaaaatcagcgatgcgtttcctgaaccgtatgtagcgattgaagtgaattatacggagggcttcagcggaagcaacctgttagtcgtggaacaaagtgacgcggcgatcattgctgacttaatgatcgggggagacggaaaaggtgcggacccttcactgggtgaaatccatttaagtgcggttcaagaagcaatgaaccaaatgatgggatcggctgccacatcaatgtctactgtattcagtaaaaaaattgatatttcacctcctcgggttgaattgctggatgttactgaagaaaagggtacagaccgtattcctgatgatgaaatgctggtgaaagtttctttcaacttaaaggtgggagaattaatagattccagcattatgcagctttacccattgacatttgcgaaagatttaatttcaagccttatgaactcagaaagtgcagaggaagaagaaacggtgcagcctgaagttacatacgaacagccgaaagagcctgtgacgccagagccgcgtattgaaccgaagcaacagcagcagccgccaaaaaggcagggaacagcaaaaaaagcagcgccagttcaggtttcaccggtggaattttcagcgtttgatccaaacgaagctgtacaagcccctattcataatctggatatgcttttggatatcccgctttcaattactgttgagcttggcagaacgaagagaagcgtaaaagagattttagagctttctgccggaagtattatcgagcttgataaattagccggtgagcctgtagatattttagttaatcagcgtatcgttgccaaaggcgaggtcgttgtcattgaagaaaacttcggagtaagagtcactgacattttaagccaggcagagcgcattaataatttaaaataacgaaacacaaggagagagatagattatggcacatagaattttaattgtagatgacgcagcatttatgcgaatgatgattaaagatattttggttaaaaatggttttgaagttgtggcggaagctgaaaatggagcacaagcggtagagaaatataaagagcattcacctgaccttgttactatggatatcacgatgccagaaatggatggtattacagcattaaaagaaattaaacaaattgatgcgcaggcaagaatcatcatgtgttctgctatgggacagcaatcaatggttattgatgccattcaggccggcgctaaggatttcattgtgaaacctttccaggctgaccgtgtgcttgaagcaatcaacaaaacattaagttaaagggtgtacgactgttgaaaaagagtcaatattttatcgtttttatttgttttttcgttttattcagtgtacatccgattgctgctgccgcggcagactctgataattcaactgtaaacgaatggtttcaaaagaaagatgaaaaaactgcggataagtcagagcaaaagaaagaaaaaacaacaaaaactgctgatgagacggagggagcggctgctccttctgtctcagcttttgattttgtaaagatgattttcgctttactgtttgttatcgtgctgatttacgggctggttaagctcatgaacaaaagaaatcggctcctaaagccttttcaatatgttgaaaatattggcggcacatcggtcggccagaacagatccatacaattgatcaaggtcgggaaaagtgtgctcgtcgtcggtgtaggagagacgatccagctgctgaaagaaattgaggatgaaaaagagattgaagtcattctcagtcagcatgaagaggcaatgtcaagcaaaatagagtggcaaaagtttgtgaagccgcataagagttctgaacatcagccgcagcaaaaactgccttcattttcaaaagcattaaaagagcaacttgaagagttaaaacaaaaccgttctgaaggaaagaagaaaggcccacgtcatcatgaatgagtttataaatattttcagttcaagcgatccggaaaacgtaagttcaactgttaaattactattattgttaactgtattttcagtggcgcctggaatattgattcttatgacttgttttactcgcatcgtcattgttctgtcatttgtcagaacttcacttgcgacgcaatctatgcccccaaaccaggttcttatcgggcttgcgctgtttttaacattttttattatggctcctactttttcagaaattaataaagaagcgctgaccccattaatggacaacaaaatcagcttggatgaagcgtatacgaaagctgaggaaccgattaaagaatttatgagtaaacacacaaggcagaaggatctggcgctgtttatgaattacgcgaaaatggataaacctgaatcattaaaggatattccgctaacaacaatggttccggcttttgccatatcggagcttaaaacagcatttcaaataggttttatgatttttatcccttttttaattatagatatggtagtggcgagcgtcttgatgtcaatgggaatgatgatgctgcctccagttatgatttctctgccctttaaaatattactttttgttttggtagacggctggtatttaattgtgaaatctttgcttcagagcttttagggtaggtgctaaacgtgagttcagaatttgtaatttctatggcggaaaaagccgtatacgtaacgctgatgatcagcgggccattattggctattgctttactggtcggtttaattgtcagcatatttcaggcgacaactcaaatccaggaacagactttggcgtttattccgaaaatcgtggcggttctcctggctctcattttttttggtccgtggatgctgtcgacgattctttcatttacaacagagctgttttctaatttaaatcgttttgcagggtaatgtagagatgaattcaattattgacttatttcctgcttttttattggtttttattagaatctctgctttttttgtaacgattccgctatttggacatcggaatgtgccagctgttcatcgcataggatttgctttttttcttgcagtcatttgtttcagcaccattgataaaccgccctctttggagatagatgagcactatatgctcttggcgtttaaagaagctttggtcggcctatgtctgggtttaattgcttatatgatgattgccgcagtgcagattgccggctcgtttattgattttcaaatgggattttcaatagcaaacgttattgatccgcaaaccggtgcacaaagtccgttgattggccagtttatctatacgatggcacttttgtttatgctgagtgtcaatgcccaccatttgctgctagacggtatttactacagctttcagtatatttcagttgatcaggcatttccgaatttcggcgatgaaaagtttgcctattttatcgcgaaaagctttaatgcaatgtttattatcgcttttcaaatgtcagcgccggttgtggccagtttgtttctagttgatttagcattaggtatcgtggctcgaactgttccgcagttaaatgtatttgtggtcggtctgcctttaaagatcgctgtcagtttcatcatgctcattgtatgtatgtccgttatcttcgtcgttgtccggaatgttttcagtttaacgattgaaacgatgcggaatcttttagcattggtcggtgtttcttaatgaagcttagagttgacctgcagttttttgcgggagagaagacagaaaaagccactccgaaaaaacggaaggatacgcgaaaaaaagggcaagtagccaaaagctcggatgtcaataccgccgtttctttactggtaatattcctttcgcttattgcaattggtccgtatatgagagacaggctgctgtcattcatagaaacattttataccgaatctctcacaatgaagctctcagaatcaaatgtgcatacattgtttgtcagcttattaaaggatatgggcatgatactcgcaccgatcttgcttgttgctcttgttgcaggagtcgtaagcaactatatgcaggttgggttcttattttctgctgaagtgatacagcctaagcttgaaaaactggatccgatcaaaggctttaaacgaatatacagtatgagggcgattgtagagctgattaaatcaattttgaaaatcgtagtcgtcggttttgcggcttttgctgtgctttggctgcattatggagaaattctccggcttcctctcctgacacccgaagaggcactttctttcgtttcaaaactcactttgtggatgggactaagcggtgcaggtgcattgttgattcttgcgggtctcgactatttatatcagagatttgactatgagaaaaatatcaaaatgtcaaaacaagatataaaagatgagtacaaaaaatctgaaggagacccgattatcaagtctaaaattaaacaaagacagcgggaaatggcgatgaggcggatgatgcaggaagttccaaaagcagatgtcattatcacaaacccgactcactatgcgattgctttgaaatatgatgaagaaaaaatggacgcaccttatattgttgcaaaaggcgtcgaccaccttgcgttaaaaatcaggaaaattgctaaagagcatgatgtcatgatggtagaaaacagaccgcttgcccgtgcgttatatgatcaagtggaaattgaccaggcagtgccggaagaattttttaaagttttagcagaaattctggcttacgtatataaaacaaaacaaaaagtatattgaatttttcgatttaaaaggagagaaaaaacagcatgtcaacaagagatttatccgttttaataagtgttgtcctcattgtggcgatgctggtgattccatttcctccatggctgttaagtattttgatcattattaatatttctcttgcgttgatcgtgcttctcaccacaatgaatatgcaggaagcgcttcagttttcgatttttccgtcactgttgctgcttttgaccctatttcgtttgggcttgaacgtctcaactacccgttcaattctttcacacggtgaaggagggaaagtcgtcgagactttcggaaatttcgttgtcggcggaaatgtattagttggactcgttgtatttatcatccttattattattcagtttatcgtcattacaaaaggtgctgaacgtgtttccgaggttgcagcaaggtttacgctggacgcaatgccggggaagcagatgagcattgatgctgatttaaacgcagggatgattaccgaacaggaagcgaagcatcgccgcgaaaaagtggcaagagaagcagacttttatggagcaatggacggtgccagtaaatttgtaaaaggtgacgccattgccggaatcatcattgtgatgatcaatattattttcggaatcgtgatcggaatgcttcagcagggcatgtccattcaagaggctgcttcacactttacgatgctgactgtaggggatggaattgtttcgcaaatcccggcactgttaatttctacggctacgggtattgtggtcacaagagctgcctctgaaggaaacttagggcatgacattacaggccagctgtttgcgtatccaaagcttttgtacgtcgcagcagctacgatcatgcttttaggtattttcactccgatcggcatccttctgacggggccgcttgcgggattgcttgcttttggcgcatatacactatctaaatcaggtaaggaaaaagaagaagtggatgagattcttgaggaagaggctgaggtggacgagcttaaaagccctgaaagtgttgttcagcttctacatatagatccgatagaatttgagtttggatatggcctgataccgcttgctgatgccaatcaaggcggtgatttattagaccgaattgttatgatacgccgtcagttggctttggaactcgggcttgtcattcctgtcgtgcgaatcagagataatatagcgttgcagcctaatgaataccgattgaaaattaaaggaaacgaggtagcaaaaggcgagctgttgcttgatcattatttagcgatgtcgcctactcctgaggacgatctcattgaagggattgaaacagtggagccttcattcggactgccggctaaatggattagcgaagcggtaaaggatgaagccgacatgcttggttatacagtagttgatcctgcatcagtcgtttcaacgcatattacggagaaaattaagcagcatgcccacgaattgatcggaaggcaggagacaaaacagctgatcgatcacttgaaagaatcgtatccagtcctggttgaagaggttacgccgaatccattgtctgtcggtgaaattcagaaagtgcttgctaagcttttaaaagaaaaagtttcaattcgaaacttagtaacgatttttgaaacacttgctgactatgggaaattaacaacagattctgatctcttgacagagtatacaagacaagcgcttgctaaacaaattacagcccagtttgccaaagaaaatgaagtgttgaaggttgttacttgttcgggccgtgtagaaaaagcaatagcagacggtgtgcagcagacggaacacgggaactatttatcacttgaaccagatatttcagaaagtatagtacgctctgtcgccaaagaagctgaacagctctcattacgtcaggaaaccgcgattcttctttgctcgccgcctgtcagaatgtatgtgaagcagcttctggaacggtacttccctgatcttccggtactctcttataacgaacttgaggcgaatgttgaggtacaaagcattggagtggtggatatttaatgaaaataaaaaaatttactgctgcttcaatgcaagaagcggcacttctcatcagaaaagagttaggtaatgaagcggtcatattaaattcgaaaaaaattaaaaagcgaaaatggtttggcctcgtcaacaagcctgctgttgaagtaatcgccgtattggatcaggactttcttgagaaaaaaacgcctcagaaggcagctgaaccgaaacaaacattaaaaactccggtcagcagtccgaaaatagaggagagaacatatccccctcaaattccggcgcaacaggagctaggtgatttttcagcatatcaatctgtacttcctgagccgctgcgaaaagcagaaaagcttttgcaagaaacagggatcaaagagtctacgaaaacgaacactctgaaaaaattgcttcgcttctctgttgaagcaggcggcttgactgaagaaaatgttgtcggcaaacttcaggaaatactatgcgatatgctgcccgcagcagacaagtggcaggagccaattcattcaaaatatatcgttctctttggttcaacaggggctggtaaaacaactacacttgctaaactcgcagccatatctatgcttgaaaaacataaaaaaatcgcttttattacaacagatacgtatcgtattgcagctgttgaacagttgaaaacatacgctgaactgctgcaggctcctctggaagtttgctatacaaaagaagaatttcagcaggcgaaggagttattttctgagtatgatcatgtgtttgttgatacagccggaagaaacttcaaggacccacaatacattgatgaactaaaagaaacgattccttttgagagcagcattcagtcatttcttgttttatccgcgactgcaaaatatgaagatatgaagcatattgtcaaacggttttcatccatccctgttaatcagtatatttttacgaaaatagatgaaacgacttccttaggttctgtatttaatatactggcagaatcaaaaataggtgtcgggtttatgacaaacggacagaatgtgcctgaggatatacagactgtatctccacttggttttgtgaggatgctgtgcagatgaacagatatgaccaagcagcaactttacgggcgaaaatggaaaaacgtgagcgcgttctgccgatgatttattcacaaaaagcgaagacacttgctgtcattagcggcaagggcggtgtcggaaaatccaatattaccttaaatatggcacttgcgctgcaggataaaggtaagaaggtgctgctcatcgaccttgatatcgggatgggaaacattgatatattaatgggaaattcatcgtctgccacgataatcgatgttttaaccgatcgtaagcctttgctgcagtcattatccgttggcccaaagggtttgcggtatatatcagggggaaccggtcttgatgtgatgtttcagctcgatcagagaaaatggacgttttttgccaatgaactttctcatgcattaagccagttcgattatgtgctgtttgatatgggagcgggcttatcaaaagatcaactgccttttattttatcagcagaagatattttgattataacaactcccgagccgacggccattatggacgcatacagcgctgtcaagcacttggttttgacagaaaataagctttcaatgaaggtggctgtcaatcgatgccgtgaccaaaaggaagggcttgacgcttttgcccgcctctcccgtacaattcatatgtttttggatgttcaggttcagtttgccggttccgtttctgacgatgtgatcgtgagcaaagcggttgtcgaacaggttccttttttcataaaaagccctcaggcaaaagccagccggtcagtccgtattttagcggacgccttgtttgaaagagaagaaacgagacacaaagaagacaaacagacatttattgagaaattatcttcttttttaatgaggagggcttaatttgattcgtgtgcttgtagttgatgattcagcttttatgagaaaaatgataagtgattttctgaccgaggaaaagcagatagaagtaatcggaactgcgagaaacggagaagaagcgcttaagaagattgaattattaaaaccggatgttattactcttgatgttgaaatgccggtcatgaatgggacagatacgctccgcaaaattattgagatttataacttgccggtcattatggtgtctagccagaccgagaaaggtaaagaatgcacaattaattgtttggagatcggtgcctttgactttatcacaaagccatcaggctcaatatctctggatctatacaaaattaaagaacaattagttgagcgtgtcgtcgcggcaggactttccggcaagcagaaacgtcctgtttcccagacagttcggcccgaacctattgtgcgtgctgtcgttaagcctgaattaagcaaaccgaaacctggcacgggcagacaaattgtgtgtatcggcacatcaacaggcggtccacgggcgttacaaaaggtgataccgaagctccctaaggatttgaacgcaccagtggttgtcgttcagcacatgcctgaagggtttactgcttctttggctgatcggctgaatcatttatctgacattcaggtaaaagaagcaaaagatggtgaagcagctcttaacggctgtgtttacatagcaccgggcggaaaaaacatatccgttattaaaaacagcgaaggactccagattgtgcttgataaccatgacacaccaagccgtcataaaccatctgctgattatttattccgttctgtcgggaaactgacagattatgaaaaagtagcggttatcatgaccggaatgggcagtgacggcactgctgggctaaaggacatgctaacagccggcaatgtgaaagccattgcggagtctgaagaatcttgtgtcgtatacgggatgccaaaagctgctgttaaagcgggtctcattcatgagattaaacatgtggaagatatcgcagcatccatcacaagctgtgtgaaaaaagagagggtgtgattcaaatggatatgaatcagtatttagatgtctttattgatgagagtaaagaacatttacaaacatgtaatgaaaagcttctccttttagagaaagacccgactgatcttcagctcgtacatgatatattcagggctgcccatacattaaaaggaatgagcgcaacgatgggctacacggatttagcacatctaacccatctgcttgaaaacgtgctggatgcaatccgaaacggagacatggcagtcacctcagactggctggatattttgtttgaagctctggatcacctggaagcaatggttcagtctattattgatggcggggatggtaaaagagatatctcagaagtgagtgccaagcttgatgtgaatggtgcgcacgctgaatccgccgcctccgcggaacctgcagaagcacagagttcagcatctgattgggaatatgatgaatttgaacgtacagttatacaagaagcggaggagcaaggcttcaaacgttatgaaatcaagatttctctgaacgaaaactgtatgttaaaagcagttcgtgtctatatggtgtttgaaaaactaaatgaagtcggagaagtagccaaaacaattccaagtgctgaagtgcttgaaacagaagattttggaactgattttcaagtttgtttcttaacacatcaatcagcggaagacattgaacaattaatcaatggcgtgtcggaaattgagcatgttgaagtcattcaaggggctcctttaacatcagctgaaaagcctgaagaatctaagcaagaagattcaccagcagcagttgtacctgcgaagcaggagaaacaaaaacagcctgctaaaaacgatgaacaggcgaagcattcagccggcggatctaaaacaattcgtgtcaacattgacaggcttgattctttaatgaacttatttgaagagcttgtcattgaccgcgggcgtctcgagcagattgcaaaagagcttgagcacaatgaactgactgaaacggttgaacgaatgacgagaatttccggagatttgcaatcgattattctgaatatgagaatggtcccggttgaaaccgtttttaacagattcccgagaatgattcgccagcttcagaaagagctgaataaaaaaattgaactctcgatcatcggtgcggaaactgaactggatcgtacagtaattgatgaaatcggagatccactcgttcacttgatcagaaacagtattgaccatggtatcgaggcgccggaaacacgtttgcaaaagggaaaaccggaatcaggaaaagttgtgcttaaagcttatcacagcggcaaccatgtctttatcgaagtagaggatgacggcgcaggccttaatcgcaataaaattctggaaaaagcgcttgagcgcggggtcataacggaaaaagaagctgaaaccttagaagacaaccaaatttacgaattgatttttgctccggggttctcaactgctgaccaaatttctgatatttccggccgcggtgtcggacttgacgttgtaaaaaacaaactggagtctcttggcggttcagtcagtgtgaaatcagccgagggtcaaggctctctattcagcatccagctgccgcttaccttgtctattatttcagttctgctgattaagttggaagaagagacatttgccattccgatttcttcaatcattgagacagcagttattgacagaaaagacattttgcaaacgcatgaccgtgaagtgattgactttagagggcatattgtccctgtcgtttatttaaaagaagagtttaaaatagaagatacaagaaaagatgcggaacagctccatatcattgtcgtgaaaaaaggcgacaaacctactgcatttgtggtggactcctttattggccagcaggaagttgtgctgaaatcactcggagattatttaacaaacgtctttgcaatttccggagctactattttaggagacggagaagtagcgctcattattgattgtaatgcactgattatttaaccattcgaggaggtgtctcacatgactgcagaaattaaaacaggcgaaaaaatgatagtctttatggtaaatggcaaagaatatgccatttccgtcactcaggtgaaatcaattgaaaaatggcaaaagccaacgagggtacctggcgtcgaaccatatatttgcggggtaatcaatttacgcggggtggtgactccggttattgatttaagaaaacgcctgaatttgccagagtatgaaattaccgatgaaacacgaattatcattattgcttatcgtgatattgaagtcggctggattgtggatgaagcgaatgatgtgattaccgtacacgaaagtgaaatagaatctgctccagaaggcgttcagaaagatacggatgtgtcgatcgaacagattgtgaaacaagagaacagactcttaaatattattgatgcgaacgcggttttggataaggaatcatctcagtccgctgtgcccgatcaagcttaatcttaaaggggttatgacatgagtatttttaatggaatcaaagaagagcagatggacattttgcgggaagtcggcaatataggcgccggccactccgcctctgcaatggcccagctgttaaatagaaagatagatatggaagtcccatttgcaaagctgctgtcttttgatgagcttgttgattttttcggcggtgccgatgtcccggttgccagtatctttttaagaatggaaggcgatttaacgggttcaatgttctttataatgcctttttttcaggcggagcagtttatcagagaactgattggaaaccccgactttgacatagaggacttaggtgaagaccacatgagctcatccgctttgcatgaactgggcaatattttagcggggtcatatttaacagctttggcggatttgacgaaactccagctctatccaagtgttcctgaagtctcattggacatgttcggagctgtgatcagcgaagggctgatggagctcagtcaggttggagaacacgccattgttgtcgacacgtcaatttttgaccaaagccatcagcaggagctgaaagcgcatatgtttatgctgccggactatgattcatttgaaaagctctttgtcgccttaggtgcatcattatgagtacaactgaggctgttgttataaaggttgggattgctgacgtgaagatcgcccgcttcccggataccattcggacctctgggttgggctcatgtgtggggctggtgctttatgataaagaaaagcaaacggcgggtcttgttcatgtcatgcttccggattcgacgttatcgaaaactgccgagctcaaccgggctaagtacgctgacaccgccgtaaagaccacgattgatatgctgatagaagcgggatgccggaaatttgcattaaaagcaaagctggccggcggatcagagatgtttaaatttaaatcgacaaatgatttgatgaagatcggaccgagaaatgtattagcgataaaagaacagctgtctttatttaatattcctattattagtgaagatacgggcggctcaagcggccggacgatagaatttgaaccgaagtcctgcatgctgcatattcgaactgttaaacaaggtgaaaaaacgatttaattaaggtattagggggataacaatgcaatccttgaattatgaagatcaggtgctttggacgcgctggaaagagtggaaagatcctaaagccggtgacgacttaatgcgccgttacatgccgcttgtcacatatcatgtaggcagaatttctgtcgggctgccgaaatcagtgcataaagacgatcttatgagccttggtatgcttggtttatatgatgcccttgaaaaatttgaccccagccgggacttaaaatttgatacctacgcctcgtttagaattcgcggcgcaatcatagacgggcttcgtaaagaagattggctgcccagaacctcacgcgaaaaaacaaagaaggttgaagcggcaattgaaaagcttgaacagcggtatcttcggaatgtatcgcccgcggaaattgcagaggaactcggaatgacggtacaggatgtcgtgtcaacaatgaatgaaggtttttttgcaaatctgctgtcaattgatgaaaagctccatgatcaagatgacggggaaaacattcaagtcatgatcagagatgacaaaaatgttccgcctgaagaaaagattatgaaggatgaactgattgcacagcttgcggaaaaaattcacgaactctctgaaaaagaacagctggttgtcagtttgttctacaaagaggagttgacactgacagaaatcggacaagtattaaatctctctacgtcccgcatatctcagatccattcaaaggcattatttaaattaaagaatctgctggaaaaagtgatacaataatgaatttcatggttagcgagtgaaaaacatgtcaacactattatggcttttaagctttacgctccacggcgttcttctgtacgctgtcattatcctgtatacgaggctcgctgcagtgaaagaaacagaaaaacagcaaaaacagatacttgaagagacggaaaacaccttggcggcatttctgcttgaattaaaagaagaaaatgagaaactgatagaaaataaagcttcatctgcaagtcaatcagatgaagaatcccaaaaaccaggcattcagcactctgaaacatatcaagagcgggatccagttcaagaggcagagaatcttcctgaacatattgaaggtctgattacagaggttgaccgtcgggaagagatcgtaaacagtgaggtccaatcatttgaagaccaggtcatagaattatatgaacagggatattcggcaagtcagattgcccagaaaatgaagagcggaaagacagaaatcgagctatttttaaaatttcgctccaaaggtgtaaaggattcttgattgtcggataaagctgtgttatattatgtcttggtgttaaatacacacgcttaacgatttatgcagagggtgctgcaggcggcagttctgcacaaaaatgacctaagcggaggaaaaaaaccattatattaggaggaaataacatgtcagtcatttctatgaagcaattgcttgaagctggtgttcacttcggtcaccaaacacgccgttggaacccaaaaatgaagcgttacattttcacggagcgtaacggaatctacatcattgaccttcaaaaaacagtcaaaaaagtagaggaagcttacaacttcactaaaaatcttgctgctgaaggcggaaaaatccttttcgtcggaacaaaaaaacaagctcaagattctgttaaagaagaagctcaacgctctggcatgtactatgtcaaccaacgctggttgggcggtacattaacaaactttgaaacaatccaaaaacgtattaaacgtcttaaagacattgaaaaaatgcaagaaaacggtacgtttgatgtacttcctaaaaaagaagtcgttcaattgaaaaaagaattagagcgtcttgaaaaattcctaggcggaattaaagatatgaaggatcttcctgatgcattattcatcatcgatcctcgcaaagagcgcatcgctgttgcggaagctcgcaaattaaacatccctatcatcggtatcgtagatactaactgtgatccagatgaaatcgatgttgttatcccagcgaacgatgacgctatccgcgctgttaaacttctaacttctaaaatggcagatgcaatcttagaagcgaagcaaggcgaagaagaagcggaagttgctgaagaaactgcaccagaaacagaaacaacaactgcgtaacctattcaaaaggtgataagagggactgccttttatcaccttttttcaagaaaaatgtgtaatatacatactcttgtttaaacatataaggaggaatacaaatggcaattactgcacagcaagtaaaagaactgcgtgaaaaaactggcgcgggcatgatggattgtaaaaaagcgttaactgaaactgacggagatatggacaaagcaattgaccttttaagagaaaaagggattgcaaaagcagcgaaaaaagctgaccgtatcgcagcagaaggttctactcttattaaaactgacggtaacaaaggcgttatcctggaagtaaactctgaaactgatttcgttgcgaaaaacgaaggcttcaaagagcttcttaacactttagctgaccaccttcttgcaaacacgccagcagatgttgaagaagcaatgggtcaaaaaatggaaaatggctcaactgttgaagagtacatcacaagcgcagttgctaaaatcggtgagaaaatcactcttcgtcgctttacagttcttacaaaagacgaaagctctgcattcggtgcgtaccttcacatgggcggccgcattggtgtattaactgttctcaacggtacaactgatgaagaaactgcgaaagatatcgcaatgcacgttgctgcagttaaccctcgttacatttctcgtgatcaagtatctgaagaagaaacaaatcatgagcgtcaaatcttaactcagcaagccctccaagaaggcaaacctgaaaacatcgtagcgaaaatggttgaaggccgtctgaacaaattcttcgaagaaatttgtctattagaccaagcgttcgttaaaaacccagatgaaaaagtgaaacaagttattgcagcgaaaaacgctactgttcaaacttttgtccgctatgaagttggagaaggcatcgaaaaacgtcaagaaaactttgctgaagaagtaatgaaccaagtgaaaaaataatggtgaaaagatttcgcggctaagtcgcgtcttttcaggcagtataggggacacattttgtgttccctatttttaaaactatatttacaaacctttttttctcttgcataatagaaaacggcaatgtttacacttggaggttatcatggaaaaaccaaaatacaaacgtatcgtattaaagcttagcggggaagcattggcaggagaacagggaaatggaattaacccgactgtcattcaatccattgcaaagcaagtgaaggaaatcgctgagcttgaagtcgaagtggctgttgtagtaggcggcggcaacttatggcgcggaaaaacaggaagtgacctgggcatggaccgcgcgactgctgactatatgggaatgctggcgacagtaatgaattcgcttgctcttcaagacagcttggaaacactcggaatccagtccagagtgcaaacatccattgaaatgagacaagttgctgaaccgtacataagaagaaaagcgatacgccacttagagaaaaaacgtgtcgttattttcgctgcgggcacaggaaacccatatttctcaactgatacgacagctgcactgcgggctgctgaaattgaggcagacgttattttaatggctaaaaataacgttgacggtgtgtataatgctgatcctagaaaagatgaatcagctgttaagtatgaatcactttcttatcttgacgttcttaaagacggcctggaagtcatggattcaacagcttcctctttatgtatggacaatgacattccgcttatcgtcttttctattatggaagaaggaaatatcaaacgtgccgttatcggtgaatcaatcggaacgatcgtgagggggaaataacgtgtcaaaagaagtattaactcaaacaaaagaaaaaatggaaaaagcaattgctgcttatcagcgcgaattggctactgtacgcgcaggccgtgcaaatccatcattattagataaagtaacggttgaatattacggagcgcagacacctttaaatcagttgtcttctattaacgtgcctgaagctcgtatgctcgttatcacgccatacgacaaaacagcaatcggcgatatcgaaaaagcaattttaaaagctgatttaggtcttacaccaacaagtgacggcaatatgattcggattgcaattccggcactaacagaagagagacggaaagaattagtgaaagttgtaaaaaaatatgctgaagaagcaaaagtagctgttcgtaacgttcgccgtgatgctaacgatgatctcaaaaaacttgagaaaaacggagacattactgaggatgaactgcgtgcttccactgaagacgttcaaaaactgacagatgaatatgtgtcaaaaattgacagtgtcacaaaagacaaagaaaaagaaatcatggaagtttaatgaaaaactatgtacaatagataatagtgaaaagaccctctcatgtttacagggggtttttttgttaatactgttgattacattgattatcagcagggaatgtaacctttttgggtgacggaggaatctcatgctcaacatactcaaaaattggaagaatcagcaaactgcggcttccaacttagaacgttatacaaaagaagacatacttaagggagaaattcccgaacacatcgccattatcatggatggaaatggccgttgggctaaaaaacgctctcttcccagaattgcaggccaccatgaagggatgaaggtggtaaaaaggaccacgaagctcgcaaacgaattaggtgtcaaagtactgacattgtatgcattttcaacagaaaactggaaaagaccgaaaatggaagtcgattttttaatgaagcttccggaagaatttttgaatacgtatcttccagagcttgttgaggaaaatgtacaggttcggatcattggggatgaaacggctttgccggcgcacacattacgtgcgattgaaaaagctgtacaggacacggcgcaaaacgacggaatgatccttaattttgctcttaactatggaggccgtactgaaattgtcagtgctgcaaaatcactcgcggaaaaagtgaaggaaggctctttgaatattgaagacattgatgaatcgcttttttctacttatttgatgactgaatctttgcaggatcctgaacttttaattcgaacgagcggcgagataaggctgagtaattttatgctatggcaggttgcctacagtgaatttgtctttactgacgtcttgtggcctgactttaaagaagaccacttcttgcaggcgttaggagagtttcagcagagaggccggaggtttggcggaatttagaggatggtggacatgaaacaaagaattttgacaggtgttctggcagcaattgtatttttatttttggttattgtcgggaaattgccgttcaccatattaatttatgctatgggcagtgtggcgctttttgaacttttacggatgaaaaagctgaagctggtttcactgccgggtttgatcggtcttttattattgtggatgttcttattgccaagccagtattcgttttttgaagcggacggaatttccaaaatggaaatcgctttatttgcggtattgctattgctgacttacacagtgttggtcaagaacacctttacttttgatgaagtcggatttattacgcttgcagcaatttacatcggaatgtgttttcattattttatcgaaatcagaaatcttgaccaatacggattaacatacattttttatgcgtgtgttgtcatttggtccaccgattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgtttttggacaactgggagatttagtggaatccgcgttgaaaagacattacgatgtaaaggattctgggaatattcttcctgggcatggcggtatattagaccgttttgacagtttcttgtttgtcatgcctttcttgtactttctgcttgcccttttttcataaaaaagtctagtatgaatatgagactgatcatgcagcaataagaataggagtagtggcaactttgaaaaatatttgtcttttaggagcaacaggatcaatcggcgaacagactcttgatgtactgcgtgcacatcaagatcaatttcagctggtatctatgtcgtttggcagaaatattgataaggccgttccaatgattgaggtctttcagccgaagtttgtctctgtcggtgatctggatacatatcataaattaaaacaaatgtctttttcttttgaatgccaaatcgggctgggagaagaaggactgatagaagcagcagtgatggaggaggttgacattgttgtcaacgctttgcttggaagcgtcggccttatcccgacgttaaaggcaattgaacagaaaaaaacaattgcgcttgcaaataaggaaactcttgtcactgcagggcatatagtaaaagaacatgctaagaaatatgatgttccgctgctgcctgttgacagtgagcattcagccatttttcaagctcttcaaggcgaacagactaaaaacattgaacgcctcatcattacggcatccggcggaagttttcgggacaagacgcgggaggagctcgaatcagtaacagttgaagatgcattaaaacatccaaactggtcaatgggtgcaaaaattacaattgattcggctacaatgatgaataagggattagaggtgatcgaggcacactggcttttcgatataccttatgaacaaattgatgtggttttacataaggagagcatcatccattcaatggttgagttccatgataaaagtgtgatcgcacagctcggaactccggatatgagagtccccattcaatatgcgctcacttatcctgaccgattgccattaccagatgcgaaaaggcttgaattatgggaaatcggcagccttcattttgagaaagctgattttgacaggttccgatgcttacaatttgcttttgaatcaggtaaaataggaggaacaatgccgacagtgctaaatgcggcaaatgaagtagctgtcgctgcctttttagctggcaagataccgtttttggctattgaagactgtatcgaaaaggcactaacccgccatcaattactgaaaaaaccgagcctggcggacattcaagaagtggacaaagatacccggggatacgtcaattcaatactcacataaggtggtatgttcgtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcgggtttgttcgtatggccggcgaagatccggaaatgattgaggtgaaacccggatacacggtcgggcttctctttaataaagaagatcaagttgagaaagtcatcatcaatcaaaaggaaaaatatccggatgctttagtcattgaagtggaaacagcggatctagagcatgacatgaagatcacaggttatgaacaggggaaagaggacgaactttccagctttactgtcagcgaaacatccttttttattgtagacggagaagaagtgcagattgcgccgtataatcgccaatttggttccaaacctgtgtggcagcggattaaagcaattgctgcagggccgattatgaactttattttagcttacgtcattttagtgatgcttgggctgattcaaggcgtaccgtcaaatgaacctatgctcgggcagctgacagacaatggacgggcggctgaagcagggctaaaagaaggggattatatccaaagcattaacggagagaaaatgaggtcttggactgacattgtctccgctgtaaaagaaaacccggataaagaaatggacgttgcagtaaaaagagataacaaaacgcttcatatttcagtgactccggaagctgttaaagatgagaacaaaaaaacaatcggacgtttcggttcctatgcgccgactgaaaaaggcgtcctctcagcagttgcttacggcgcgacatcaacagttgatgtcactaaagcgattttaaccaatctgagcaaattagtaacaggccaatttaaactcgatatgctgtcaggtcctgtcggcatatatgatatgacagaccaagtggcgaaaacagggatcgtgaacttatttcagtttgcggcgtttttaagcattaaccttgggattgtcaatctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaaacgaaaagtaaatcaatcagaggtgcgaagaaatgagacaaagcttgacgcttattcctacgctccgtgaagttccagctgatgccgaagcaaaaagtcatcagcttcttctgagagcaggatttatcagacagaatacgagcggggtatacagctatatgcctctggcgtataaggtgattcaaaacattcagcagattgttcgagaggaaatggagaaaattgatgccgtagaaatgctcatgcccgcattgcagcaggcagagacatggcaggaatcaggcagatggtatacgtatggtcccgaactgatgaggctaaaagaccgtcatggccgtgaatttgctttaggggcaacgcatgaagaggttatcacttcgcttgttcgcgatgaggttaaatcttataagcgtctccctctgactctttatcaaattcagtctaagttcagagatgaaaaacgtcctcgcttcggtttgttaagaggccgcgaatttattatgaaggatgcgtactctttccatgcatctgcagagagtctggatgaaacgtatcaaaaaatgtacgaagcctattctaatatttttgcccgctgcggcattaatgtaagacctgttatcgctgattcaggcgcaatgggaggaaaggatacgcacgaatttatggcactttctgcgatcggagaggatacgattgcgtattctgatgaatcacagtacgcggctaatatcgagatggctgaagttcttcaccaggaagttccttcagatgaagagcctaaagctctagagaaggttcatacgcctaacgtgaaaacaatcgaagaactgactgcgttcttgcaggtttcggctgaagcgtgcattaagtcagtattgtttaaagctgatgaccgttttgtcttagtgcttgtaagaggggatcatgaagttaacgatattaaagtgaaaaacttgcttcatgcagaagttgtagagcttgccacacatgaagaggtcattcagcagctcggaacagagccaggttttgtaggccctgtcggtattcatcaggatgtggaagtatatgccgatcaagctgtgaaagcaatggttaatgctgttgccggggcaaatgaaggagatcatcattataaaaatgtcaatgtgaatcgtgacgcgcaaattaaagaatttgctgatcttcgttttattaaagaaggtgatccttcaccagacggcaagggaacgatccgttttgctgagggaatcgaagtcggacaagtctttaagctcggaacacgctattcagaagcgatgaatgcgacatatttagatgaaaacggacgcgcgcagccaatgctgatgggctgttacggaatcggtgtgtcaagaacgctttctgctattgctgaacagcatcacgacgaaaaaggcttaatatggccaaaaagcgttgcgccgtacgatcttcatattcttgcattgaacatgaaaaacgatgggcaaagagagcttgctgaaaagctgtatgccgatttaaaagcggaaggctatgaagtgctctatgacgaccgtgctgagcgtgccggcgtaaaattcgctgattcagatctaatcggccttccaatccgcatcactgtcggaaaacgggctgacgaaggaatcgtcgaagtgaaaattcgccaaactggtgagtcaactgagatttcagtagacgaattatctgcgtttatcagcaagcagtaatcaccataacgatttatcaaaaaacatgttaaaatagaaataatagaaggtacctcattgcctgaggtaccttcacttatgatgtttttagggagggatactgtcttaatggaacagttatcagtaaacagaaggcagtttcaaattcttctgcagcagattaatatgacagatgataccttcatgacatactttgaacatggcgagattaaaaagctgacaattcacaaagcttctaagtcttggcattttcattttcaatttaaatctttgctgccttttcaaatatatgacacattaacaacgaggctgacgcaatcgtttgcccacatagcaaaagtgacatcttcaattgaagttcaggatgccgaggtcagtgaaagtatcgttcaagactactggtcacgctgcattgaagaactgcagggcatttcgccgccgattatcagtcttttaaaccagcaaaaaccgaagctgaagggcaataaactgattgtcaaaaccaaaacggatacagaagcggctgcgctaaaaaacaaatacagttccatgattcaagcaggctaccgtcaatttggctttccggatcttcagcttgatgctgaaatatttgtatccgagcaggaagttcaaaagtttcgggaacaaaagcttgcggaagaccaagagcgggcgatgcaggccttgattgaaatggagaagaaagataaagaaagtgatgaagaccaagcaccatctggtcctcttgttatcggttatcaaattaaagataacgaggaaatccggacacttgacagcatcatggacgaagaacggagaattacggtccaaggttatgtgtttgatgtggagacgcgcgagctgaagagcgggcgcacgctgtgtatcttcaaaattacagactatacaaatagtattttgatcaaaatgtttgcacgtgaaaaagaagatgcggcactgatgaagtctctgaaaaaaggaatgtgggtaaaagcacgcggaagcattcaaaatgatacatttgtcagagaccttgtcatgatcgcaaatgacgtaaacgaaataaaagcaaaaacccgtgaagattcagcacctgaaggagaaaaaagagtggaattgcatcttcattccccaatgagccaaatggatgctgttacgggtatcggaaagcttgtcgaacaggcgaaaaaatgggggcatgaggccatcgctttgactgaccatgctgtcgttcaatccttccctgatgcgtattctgcggcaaaaaagcatggaattaaaatgatttacgggatggaagcgaatctcgtggatgatggcgtgccaattgcttataatgccgcacatcgtctgctcgaagaagaaacatatgttgtttttgacgttgagacgacaggattgtctgctgtatacgataccattattgaactggctgcagtaaaagtaaaaggcggagaaattattgataaatttgaggcgtttgcgaacccgcatcgtccgctttccgccacaatcatagagctgacagggatcactgatgatatgctacaagacgctccggatgtcgtagatgtaataagagatttcagagaatggattggcgatgatatccttgtcgctcataatgcaagctttgatatgggattcttaaatgtagcctataaaaagcttcttgaagtcgataaagctaaaaacccagtcattgatacgcttgaacttggacgttttctctatccggaatttaagaaccaccggttgaacacactttgtaaaaagtttgatatcgaactcacacagcatcaccgtgcgatctatgatactgaggcaaccgcttatttgcttctgaaaatgctgaaagacgcagctgaaaaaggcattcagtaccatgatgagttgaatgaaaatatgggtcagtccaatgcttatcaaagatcaagaccgtatcatgcaacattacttgccgtgaacagcacgggacttaaaaatttatttaagcttgtgtcactttctcatattcattatttttacagagtgccgcgtattccgagatctcagcttgagaaatacagggaagggctgctgatcggttctgcctgtgacaggggagaggtttttgagggaatgatgcaaaaatcgcctgaagaggtggaagatatcgcgtcattttatgattaccttgaggttcagccgcctgaagtgtatcgtcacttgctggagcttgaactggtccgtgatgaaaaagcgctgaaagaaattattgtgaatatcacgaagctggggaaaagcttaataaaccggttgttgcgacgggaaatgtccattacttgaatgatgaggataaaatctacagaaagattttaatatcctcacaaggcggggcaaatccgctgaacaggcatgaactgccgaaagtgcatttcagaacgacagacgaaatgcttgaagctttttctttcttaggtgaagaaaaagcgaaggagatcgtagtcaccaatacccaaaaggttgcttctttagttgatgacatcaagccgattaaagatgatttatatacgccgaaaatcgaaggcgctgatgaagagatcagagaaatgagctatcagcgtgcaagaagcatttacggggaagagctgcctgaaattgtcgaagcgcggattgaaaaagagttaaagagtattattggccacggatttgctgttatttacttgatctctcacaaacttgtaaaacgttcactagatgacgggtatctcgttggttcccgtggttccgtaggatcttcattagttgcgacacttactgagattactgaggtaaacccgctgccgccgcactatgtttgtcctgagtgccagcattctgagttctttaatgacggttctgtcggttctggttttgacctgcctgacaagacatgccctcattgcggaacgcctttgaaaaaagacggccatgatattccatttgaaacgttcttaggatttaaaggggacaaagtacctgatatcgatttgaacttctcaggggaatatcagccgcaagcacacaattacacaaaagtattgttcggagaagacaatgtatatcgtgcgggaacaataggcacggtggcagaaaaaacagcctacggttatgtaaaaggctatgccggagacaacaatcttcatatgcgcggtgccgaaatagatcggctcgtacagggatgcacaggtgtaaaacgtacaactggacaacaccctggcggtattattgtagttccggattatatggatatttatgatttttcaccgatccagttcccggcagatgccacaggttcagagtggaaaacgactcattttgatttccactccatccatgacaacctgttaaaacttgatattctcggacacgatgacccgactgttattcggatgcttcaagacttaagcggaatagatccgaaaacaattccgacggatgatcctgaagtgatgaagatcttccagggaaccgaatcactcggtgtgactgaagaacagattggctgtaaaacgggtactcttggaattcctgaattcggaacccgatttgtccggcagatgcttgaagatacaaagccgaccactttttctgagctcgttcagatttcaggcttgtctcacggaactgatgtatggcttggcaatgcacaggagctcatccacaataatatttgtgagctgagtgaggttatcggctgccgtgatgacattatggtttatttaatctatcaaggccttgaaccgtcccttgcctttaaaatcatggaattcgtgcgtaaaggaaaaggattaacgcctgaatgggaagaagaaatgaaaaataacaatgtcccagactggtatattgattcctgtaaaaagattaaatacatgttcccgaaagcccatgccgcggcatatgtcttaatggcagtccgcattgcttactttaaagtgcatcatgctcttttgtattatgcggcttattttaccgttcgtgcagatgactttgatatcgatacaatgatcaagggctctacagcaatcagagcggtaatggaggatataaactctaaaggacttgatgcttcaccgaaggaaaagaaccttctgactgttttagaattagcgcttgagatgtgtgagagaggctattcattccaaaaagtcgatttatatcgctccagcgctacagagtttattattgacggcaacagtcttattccgccgtttaactctattccaggattagggacgaacgctgctttgaacattgtaaaagctcgcgaagaaggcgaattcctctcaaaagaagatttgcaaaagagagggaaagtatcaaaaacgattttagagtacttagatcgccatggctgtctggaatcactgcctgatcaaaaccaattgtcattgttctaatatggaaagcagaatttctcagaaattctgcttctatgcatacataagcgcaaaaagtgccatcgtaatattagagtttctgtacttgcttaggtatgaaggtaagcgtatatccatttgcaataaaaatatggttatggtatagttttattggaaatgctaacgattaccgaggcaaagagtggggaaacccgctcttttgtattgaacaggagaattttgtctcgacatgttcatcgtttactttttagcccctgctcttttgaagcagggtttttatgcagagtgacgagacgaatatgagatcgacagcacaaggaggaagaacatgagcaaaaaagtgactgacaccgttcaagaaatggctcagccaatcgtagacagccttcagctggaactcgttgacattgaatttgtcaaagagggccaaagctggttccttcgcgtgtttattgattccgatgacggtgtggatattgaggaatgtgccaaagtaagcgaagctttaagcgaaaagcttgatgaggcagacccaatcagccaaaattactttcttgaagtctcatctccaggagctgagcgtccgctaaagaaaaaagccgatttcgaaaaatcactaggaaaaaacgtatacattaagacgtatgagcctattgacggcgtaaaagtgtttgaaggtgaactggctgaatttgatggacaaacagtgacagttgagatcacgatcaaaacaagaaagaaacggatcaatattccgtatgaaaagatagctaatgcaagattagctgttacattctaatgaatacaaatgttttaaggggggagaccgttaaatgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagagatctcaattgaagaggcgcagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggtgtgatttattctgaatttatcgaccgtgaagaagacatcatgacagggatcgtccagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggcccgcagatttatgtgtcaagaacacatccaggcctgttaaagcgtttgtttgaaattgaagtgcctgaaatttatgatggaactgtcgagctaaaatctgttgccagagaagccggcgaccgttcaaaaatttctgttcgcacagatgatcctgacgtggatcctgtcggttcatgcgtagggcctaaaggccagcgtgtgcaagcaatcgtcaatgaattaaaaggtgaaaaaattgacattgtcaactggtccagtgatcctgtagaatttgtcgcgaatgcgctcagcccttccaaagtgcttgatgtcattgttaatgaagaagaaaaagcgacaactgttattgttcctgattaccagctgtctctggcaattggcaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataagaggtgactttaggtgaataaacacaaaaagatcccattacgcaaatgtgtagtgactggtgaaatgaagcctaaaaaggaactgatccgagttgtacggtcgaaagaaggcgaaatctcagtagacccgaccggaaaaaagaatgggcggggtgcttatttaacgctggataaagagtgcatcttagcagcaaaaaagaaaaacactttgcaaaatcaatttcaatcacaaatcgatgaccagattttcgatgaattgctggaactggcggaaaaggtgaaaaaataaaatgtctggaatggaatggtttcccttgctgggtctggccaatcgagctcgtaaggtcgtgtcaggcgaagacttggtaataaaagaaatcaggaatgcgcgtgcaaagcttgtcctgcttacagaggatgcatcatctaacacagcaaaaaaagtaactgacaagtgcaattattataaagtcccttataaaaaagtcgagagtcgcgcggttcttggacgctctatcggtaaagaagcccgtgtcgttgtcgccgtcactgaccaaggttttgcgaataagctgatcagcttgctcgattaatatttttgggggtgaacgaatggctaaaatgagagtatacgaatatgcaaaagcgttaaatgtttcaagtaaggaaattttgaccgcactgaagaacatggatttagaagtgaataatcacatggccatgcttgaagaaaaggccattaaaaagcttgatgccaaatataaaaaaggcggcgcagctgctaaatctcaaaagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaacaataaaaaccaacatcagcaaaagcctgtaaagccgaaaaaagagcttcctgagaaaattacattctctggcactttaacagttggcgcacttgctgaagagcttggcaaagagccttcagaactcattaaaaagctgatgcttcttggcgtaatggctaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggagaagcaggcggaatcactcagcatatcggcgcttatcaaattgaagagaacggcaagaaaatcacgttcttggatacaccgggccacgccgcatttacaacaatgcgtgcacgcggtgcagaagtaactgatattacgattcttgtcgtagctgccgatgacggtgtcatgccgcaaacagttgaagcgattaaccatgcaaaagcagcagaggttccaatcatcgtagctgtgaataaaatagataaagaatccgcaaaccctgaccgtgtgatgcaagaactgacggaatacggacttgtccctgaagcttggggcggagaaaccatttttgtgccgctttctgctttaactggaaaaggcattgatgagctcgttgaaatgattttgcttgtcagtgaggtagaggaactgaaagcgaatccgaaccgtcaggcaaaaggaacggttattgaagctgaactcgataaaggcagagggtcagttgcgacgttgctcgtacagactggaacactgcatgtcggtgatccgatcgtagtcggcaatacatttggccgtgtccgtgcaatggtcaacgacattggccgccgtgtgaaaactgccggcccatcaactccggttgaaattaccggtttgaatgatgtccctcaagcaggagaccaattccttgtctttaaggatgaaaaaacagctcgttctgtcggtgaagcccgtgcttcgaaacagcttgaagagcagcgcagcgataaagcgaagctcagtcttgatgatttattcgagcaaattaagcaaggtgatgtaaaagacatcaacctcatcgtaaaagctgacgttcaaggatctgctgaagctttaacggctgcgcttcaaaaaattgaagtagaaggcgttaaagtgaaaatcatccatacaggcgttggtgcgattactgaatctgacattatcttggcatctgcttccaatgcaattgttattgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgaaggcgaagtagatgttctgaaacgctttaaagacgatgtgaaagaagtttcacaaggctatgaatgtggtattacaattaagaaatacaatgacattcgtgaaggtgacatcctagaagcgtttgtcatgcaagaaattgaaagaacgtgatcggatttgcggagtgtgaatgcatcatttatgatgcaggatcgctaaaagaaaagcgtgccgttctgaagcggattttaaccagggttcaaaacaagttcaatgtttcgatttcggagattggctatcaggacacctggcaaagaaccagcttcggaatcgccgctgtttcttcctctcgcgttcaaacagaaaaagaactgcagcgcgtcctagcgtttatcgattcttttcctgaaattgaacggacgatcactaggacagagtggttttaacttagaggtgattgaattgagtatgagagcaaaccgtgtcggcgagcagatgaaaaaagaactcggtgatattatcagccgcaagctgaaagacccgagaattggttttctgacagtaacggatgtacgtgtatcaggtgatttgcaaattgcaaaggtgtatatctcggttctcggtgacgagaaaaaacgggaagaagcgctgaaaggactggcaaaagcgaaaggatttatccgatccgaaatcggcagccgcatcagacttcgaaaaacgcctgaaattgaatttgagttcgatgaatcaatcgattacgggaatcggatcgaaacactgattcacgaattacattcagagaaaccatctgaataaaaaatgagaggataggcgtatatcgtctgtcctctttcttcgtttaaaagaaaaaagttaaaaaagaaggagtgaaaggcaaatggttaacggagttctccttttacataaacctgttggcatgacatcgcacgactgtgtcatgaagatccgaaagctgttaaaaacaaaaaaagtaggacatacaggaacgctcgatccggaagtgtcaggcgtgcttccgatttgtgtaggaagagcgacaaaaatagtcgaatacttaactgaaaaatctaaaacgtatgatgcagaaataacgcttggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcggggattgaagtagaacgtccgaaacgtatgataaccattgaagacattgccctgacgacagagattaaacatcatggagaaaccgcaagcttccggtttacagtgacttgctccaaagggacctatgtaaggacgctggcggtcatgatcggagaaaagctcggatatccggctcatatgtctcatttaatccgtacggcatccggagatttttctctcgacgaatgctttacttttgatgagctcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtgaagaccgtatcgccgtctttactgaatccggaacctgtttggcgatctatttccctcatcctgcaaaaaaagggctgttaaagccggcaaaagtattgatgcaaaaaagcgaacaatagaaaaaaggtgaccgttctgtgaagacgatacatattacacatcctcatcatttaataaaagaggagcaggcaaaatcagtgatggcgttaggatattttgacggcgttcatctcgggcatcaaaaggtaatctgcacagcgaagcaaatagccgaagaaaaaggtctgacattggctgtgatgacctttcatccccatccttctcacgtgttgggcagagataaggaacctaaggatctgattacgcctcttgaagacaaaataaatcaaattgaacaattaggtacagaagttctgtatgtcgttaaatttaatgaagtgtttgcttctctttctcctaagcagtttatagaccagtatattatcggccttaatgtgcagcacgcagtggcaggctttgactttacgtacggcaaatacggcaagggaacaatgaagaccatgccggatgatttagacggaaaagctgggtgcacaatggtagaaaaattaacggagcaggataaaaaaatcagttcttcgtatatccgtaccgcgcttcaaaacggagatgttgaattggcgaatgtcttgcttggacaaccttattttattaaaggaattgtcattcatggtgataaaagagggcggaccatcgggtttccgacagcgaatgtcggtttaaataacagctatatcgtcccgcccacaggtgtatatgccgtaaaagcggaagtgaacggcgaagtttacaatggcgtttgcaatattggctataagccgacgttttatgaaaagcgccctgagcagccttccatcgaggtcaatctgtttgatttcgatcaagaggtatatggagccgctataaaaatcgaatggtacaaacggattcggagcgagcggaaattcaatggcatcaaagaattaacagagcaaattgagaaagataagcagcaagccatccgttatttcagcaatttacggaaataacttgcaacgcacgcaaattttattctaaaatatttgcatataggcacgatttttagtatgatagttttcgtagtcttaaaaccattgcttggcaatccgaagtcaccgacggttgctaggtaactggggctaaatatgatttggaggtgaaacaggatggcaattactcaagagcgtaaaaaccaactcatcaatgagttcaaaacacacgaatctgatactggatctccagaagttcagatcgctatcctaactgactcaattaacaacttgaacgagcatttacgtactcacaagaaagaccaccactcacgtcgcggtcttcttaaaatggtaggtaagcgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaatttcttataacaaatcattgaaatccttttacatactactttgacattgatatgttcaattcatttcgttcataataggagtaattgattatttcacacaacgaagagaggagttcgtaattgtatgggacaagaaaaacatgtctttaccatagattgggccggaagaacgcttactgttgaaaccggccagcttgccaaacaggcaaatggtgctgtgatgatccgctacggtgatacagcagtacttagtacagcaaccgcttcaaaagaacctaaaccgcttgatttcttccctcttactgtaaactatgaagaaagattatatgcggtagggaaaattccgggcggatttattaaaagagaaggacgtccaagtgaaaaagcggttcttgccagccgtttaattgaccgtccgatccgtcctttgtttgccgatggattccgtaatgaagttcaagtcatcagcattgtcatgagtgttgaccaaaactgctcttcagaaatggctgccatgttcggttcatctcttgcactttctgtatcggatattccgtttgaaggaccgattgcaggggttactgtcggacgcattgatgatcaatttatcattaacccgacagtcgatcagcttgaaaaaagcgacatcaatcttgtcgttgccggcacgaaagatgcgattaacatggtagaagcgggagcggacgaagttcctgaggaaatcatgcttgaagccattatgttcggccatgaagaaattaaacgcctgattgcattccaagaagaaattgttgcagcagtcggcaaagagaaatctgaaattaagctctttgaaattgatgaagagcttaatgaaaaagtaaaagctttggcagaagaggatctgctgaaagccatccaagttcatgaaaagcatgcccgtgaagatgccattaacgaagtgaagaacgcagttgtggcaaaattcgaggatgaagaacatgatgaagacacaatcaagcaagtgaagcagattttatccaagctggtgaaaaatgaagttcgccgcctgattactgaagagaaagtaagaccggacggccgcggtgtcgatcaaatccgcccgctctcttcagaggttggcctcttgccaagaacgcacggttcaggtctatttacaaggggacaaactcaggccctcagcgtatgtacgctaggtgctctgggagatgtgcaaatccttgacggcttaggtgtcgaagagtcgaaacggtttatgcatcattacaacttcccgcaattcagcgttggggaaacaggaccgatgcgcggaccgggacgtcgtgaaatcggacacggagcactgggtgagcgtgcgcttgagccagttattccgtctgaaaaagacttcccttatactgtccgtcttgtttcagaagtgcttgaatcaaacggttctacatctcaagcaagcatttgcgcaagcacacttgcaatgatggatgccggtgtaccgattaaagcgccagttgctggtattgcgatgggtcttgtcaaatcaggcgaacattacactgtcttgactgacatccaaggcatggaagacgcgctcggagatatggactttaaagtagcgggaactgaaaaaggcgtaacggccctgcaaatggacattaaaattgaaggcctttccagagagattcttgaagaagcgcttcagcaggcgaaaaagggcagaatggaaatcctcaacagcatgcttgcaacattaagcgaatcaagaaaagagctttctcgatatgcgcctaagatcttaacaatgaccattaatcctgataaaatccgcgatgtcatcggaccaagcggaaaacaaatcaataagatcatcgaagaaaccggtgttaaaattgatattgagcaggacggcacaatctttatttcctctacagatgaaagcggcaaccaaaaagcgaaaaaaatcatcgaagaccttgttagagaggttgaagtcggccaactttacctaggtaaagtgaaacggattgaaaaattcggggctttcgttgaaattttcagcggaaaagacggcttggtgcacatttcagagcttgcgcttgaacgcgtagggaaagttgaagatgttgtaaaaatcggagacgagattcttgtcaaagtcactgaaattgataaacaaggacgagtgaatttatcccgcaaagcggtgctccgtgaagagaaagaaaaagaagaacaacaatcttaaatgaaaacataaaaggagcctgggagacccggcttctttattttgaagcttttcaaaagcaggcgggttctaccttgtccttctccttcataatgtgaggtgagggggacagaacatgtacaaaaaatttgtaccgtttgccgtttttttatttcttttttttgtctcatttgagatgatggaaaatccgcatgcacttgattatataggggcaatgaaaaaagatacggtgactgtcacggcgtcaaaagacccgttatatgaagaattgcttcaaaaagcgccggagtacgaagttaagccccagaatgcaagaattgataaagtgtggaaaagcattcccggctacaatggattaaaggtcaatattgaacaatcatataaaaaaatgaaaaagcatggtgagtttcgggaaaaagatttggtgtacagtcaagtaaaaccaagtgttcatcttgagtcacttcagcctgagcctatttataaaggaaatcctgacaaaccgatggtggcttttttaatcaatgtggcatggggaaatgagtatttggaaaaaatgctccctattctgcaaaagcaccaggttaaagctacgttctttttagaaggcaattgggtgagaaacaatgtacagctcgctaagaagattgcaaaagacggacatgaaatcggaaatcattcatacaatcatccggatatgagcaaactgactacaggaagaatttccgagcagctcgacaagactaatgaacaaatagaacaaacgatcggtgttaagccaaagtggttcgctccgccaagcggaagtttcagaaaagcggttatcgacattgcagcagagaaacagatgggaacagtcatgtggacagttgatacaatcgattggcaaaagccggctccgtctgtacttcagacgagagtgttaagcaagatacataatggtgccatgattttaatgcatccgactgaccctacggcggaaagtcttgaagcgctgattacacagataaaagacaaaggatatgcgcttggaacagtcactgaactaatggatgaaacaagactattgaagtaacagatgaaggcagcttgtctttgaataggaggaacaaatttgattaaacgatatacgtgtcaaaatggtgtaagaattgtgctggaaaataacccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgaaaaaagagaaaaatgtagtatatgaagaaattaaaatgtatgaagatgcgccggacgacattgtacatgatttattgagcaaagccacttacggcaatcattctttaggctacccaattctaggcacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaaaggtaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagctcatatgaggacagcggaatgctaacgatttacggcggaacgggtgcaaatcagcttcagcagctgtcggaaacaattcaagaaacccttgccacattaaaacgtgacggcattacctcgaaagaactggaaaacagcaaagagcaaatgaagggaagcttaatgctgagcttagaaagcacaaacagcaaaatgagccgaaacggaaaaaatgaactgctgctcggcaaacataaaacattagatgaaatcatcaatgaattaaacgccgtgaacttagagcgtgttaacggccttgccagacaattgtttaccgaagactatgcattagcacttatcagcccttccggcaatatgccgtcttaaaaaggaaagcctgctccataatggagcaggcattttttaatccctttcatcatacatagtacaagggggtgacagacatgcggctcagtgaattatcaggaaaggaaattgtagacatcaaaagagctgaacggctcggagtgctcggccagaccgatttggaaatcaatgaacaggatggacagattacagcactcctcattcccacagttaagtggtttggtttgagaaagcaaggtcatgacattcgtgtcccatggcaccatattcaaaagatcggttcagatatgattatattagatgtacctgaggaaatgcctcctcgacaagagtaaatagcccaattgactgtgaagcgggctctaaagaaaacatctgaaacatcggctgccggagccgatgtttttttatatggaaaaagcgcatcttttatattcaccagtattttcttttgatcataagatgaaggggagcttaacaactagagatccagtatatacaaagaaggtgaacgtttagaatgttaaccggattgaaaattgcagttatcggcggtgacgcaagacagctcgaaattataagaaagctcactgaacagcaggctgacatctatcttgtcggttttgaccaattggatcacggttttaccggggcagtaaaatgcaatattgatgaaattccttttcagcaaatagacagcatcattcttccagtatccgcgacaacaggagaaggtgtcgtatcaactgtattttctaatgaagaagttgtgttaaaacaggaccatctcgacagaacgcctgcacattgtgtcattttctcaggcatttctaacgtctatttagaaaacattgcagctcagacaaaaagaaaacttgttaaactgtttgagcgggatgacattgcgatatacaactctattccgacagtagaaggaacgatcatgctggctattcagcacacggattatacgatacacggatcacaggtggccgttctcggtctggggcgcaccgggatgacgattgcccgtacatttgccgcgctcggggcgaatgtaaaagtgggggcaagaagttcagcgcatctggcacgtatcactgaaatggggctcgttccttttcataccgatgagctgaaagagcatgtaaaagatatagatatttgcattaataccataccgagtatgattttaaatcaaacggtactttctagcatgacaccaaaaaccttaatattggatctggcctcacgtcccgggggaacggattttaaatatgccgagaaacaagggattaaagcacttcttgctcccgggcttccagggattgtcgctcctaaaacagctgggcaaatccttgcaaacgtcttgagcaagcttttggctgaaatacaagctgaggaggggaaataaggatgtcgtcactaaaaggaaaaagaatcgggtttgggctgaccgggtcgcattgcacatatgaagcggttttcccgcaaattgaggcgttggtcaatgaaggagctgaagtccgtccggttgtcacatttaatgtaaaatccacaaatacccgatttggagagggcgcagaatgggttaaaaaaattgaagacctgactggatatgaggccattgattcgattgtaaaggcagaacctcttgggccgaagctgccccttgactgcatggtcattgcgcctttaacaggcaattcaatgagcaagctggcaaatgccatgacggacagcccggtgctgatggcggcaaaagcgacaatccggaacaatcggcctgtcgttctgggtatctcgacaaatgatgctcttggtttaaacggaacaaatttaatgaggctcatgtcaacaaaaaatatcttttttattccattcgggcaagatgatccatttaaaaaaccgaattcaatggtagccaaaatggatctgctaccgcaaacgattgaaaaggcactcatgcaccagcagcttcagccgattctagttgagaattatcagggaaatgactaaatttacagaaaatctttcccaaactaaaaaattcggtcatcacccgcatattctatggtaaaataaaacgtaaaatcatagtcaaatcaattcaatgaagctgattggcggaaggagttttacagatgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcacgtttaaaggccaagaactgactgttcaggaagcttctcctgagagctttgaaggggtaaatattgctttgttcagcgccggcggaagcgtatcacaagcattggcaccagaagctgtaaaacgcggcgctattgttatagataatacgagcgcgttccgcatggatgaaaatacaccgcttgttgtgccagaagtgaatgaggcagacttgcatgaacacaacggcattattgccaatccaaactgctctacaatccaaatggttgcggcacttgaaccgatccgcaaagcatatggcttaaacaaggtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagttgcggctacatgtgtgagactgccaatccaaactgggcactcagagtccgtctacattgaggtagaccgtgatgacgctacagttgaagatattaaaaatctattgaaagaagctccgggcgtgacacttcaggatgatccaagccagcagctttatccgatgcctgctgatgctgtcggcaaaaacgatgtgtttgtgggccgcattcgcaaagacttggacagagcaaacggttttcatttatgggttgtttctgataacctattaaaaggcgcggcatggaactctgttcaaattgcagaaagcctgaaaaaactaaacctcgtataaaagagagaattttctaaagacgaatagaagagagtaaggcgctatcagcctgctctcttctgttacgtccgaataatttggagtgaaaacagtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggagacccgtatgcaacagattctttgctcgggctgctttacggcgatcagtcagcgatttctcctagggaacaggatttgcttttatcttgcggagagactatttcctctgtcgtctttacaagcatgctgcttgataacggtgtgaaagcagctgcgctgacaggggctcaggctggctttttaacgaatgatcagcataccaatgcaaaaatcattgaaatgaaaccggagcgtttattcagtgtgctcgccaatcatgatgcggtagtcgtcgcaggcttccagggcgcaactgaaaagggtgatacaacaacaatcggcagagggggcagcgatacgtctgcagccgcactcggagcagctgttgatgcggaatacatcgatattttcaccgatgtagaaggcgtgatgactgctgacccaagagtggtggaaaatgcaaaaccgcttcctgttgtgacgtatacagaaatctgcaacctggcgtatcagggggccaaggtcattcatccgcgtgctgtggaaatcgcaatgcaggccaaggttccgatccgcgtccgttcgacttattcgaatgataaaggtacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaaatgtgattgaatcatgatgaggtgaataaaatgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactggaagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcggacattccgaatgtggttgcgattaaagaagcaagcggagacctcgaagcgattacaaaaattattgctgaaacaccggaagacttctatgtctattcaggggatgacgctctgacgcttcctattctttcagttggaggaagaggagttgtatcagtggcgagccatattgcaggctctgatatgcagcaaatgatcaaaaattatacgaatgggcaaacagctaatgcggcactgatccatcagaaactgctgccgattatgaaggaactgtttaaagcgcctaatcctgctccagtcaaaacagcgcttcagctgagaggtcttgatgtcggttctgtgcgtctgcctctagtcccgttaactgaggatgaacgtctgagcttaagcagcacgatcagcgaactgtaagaaaatttcatacagtgaaacaaacgcggtcattctcacattcagctgagtttgaccgtttcttttacatattggttttccctaaaccttctgctttatcttgttttctaaatttactttcagttataataggaacaagtgatgatggacgggtatgagactaggaggatatagattttgaaaaagaaaaatacagaaaacgttagaattatcgcccttggcggtgtcggagagattgggaagaacctttatgtcattgaaattgactcagacatatttgtcgttgatgccggccttatgcatccagaaaacgaaatgctcggtattgatgtagtgattcctgacatatcatatttgattgaacgggctgaccgcgtcaaggcaatctttttaacgcacgggcacgatgaaaatatcggcggcgttttttacttattaaacaagctgtccgttccagtgtacggaacaaaactgacgcttgcactgttaagagagaaattaaaacaatacggacataaccgaaaaactgatttaagagaaattcactcaaaatctgtcattacatttgaatcaacaaaagtatcgttctttagaacgattcacagcattcctgattctgtaggtgtgagctttaaaacatcacttggatctattgtatgcacgggagacttcaaatttgaccaaacacctgcacttaatcagacgtgcgacattggcgagatcgccaagatcggcaatagcggcgtgctcgctctgctttctgacagtgcaaatgcggaacggccgggttacaccccttcggaagcggctgtcagcggagaaatttcggatgcgctgtataattcacagaaccgggtgattattgctgttttcgcatccaatattaaccggattcagcaagtcattcatgcagcggctcaaaatggcagaaagattgccgtagccggaaaaaatcttcaatctgtcctgcagctggcgagaaagttaggatacattgaagcagatgatgaattgtttatttctgtacaggatgtcaaaaaatatccgaagcgcgaagtggccattattacagccggaagccaaggtgaaccattagctgctttgacaagaatggcaaacaaagctcacaaacagctgaacattgaagaaggggatacggtggtcattgcgtcaactccgattcccgggcaggaactcatttactctaaaacagtagatcttcttgcgagagccggtgcacaagtcatctttgcccaaaagcgtgttcatgtatcaggccacggctcacaagaagagttaaagctgatgatcaacctgcttaaaccaaaatatttgattcctgtaaacggcgaatacagaatgcaaaaagctcattcaaaaatcgctgaagaaaccggcatgaagcgcagtgacatcttcttaattgaaaaaggcgacgtcgttgaattccgcggccaaaacgtaaaaattggggataaagttccttacggcaatattttaattgatggtttaggtgtcggtgatatcggcaatatcgtattgagagaccgccgcttgctttcacaggacggaattttaatcgttgtcattacacttgataaacaaaagaaacatcttgtatcaggaccagaaattatcactcgcggctttgtttatgtaagagagtctgaaggtcttatcgtacaggctactgagcttgtccggtccatcgtgacagaagcgactgaaacatcaaatgtcgaatggtcaacgttgaagcaggcaatgcgggatgctttgaaccaattcctttatgaaaaaacgaaacgtaaaccgatgatcatcccaattattatggaagtataatgactgactaaagaccggagctgctccggtctttattttttgtccttcaagccgggattgaatgaagtatctttgttcataatacaaagagaaactcggaaaggatgaaagcgagatggatcatcgtatggaaaacacagaagaagagcgtcctgaaaaaaatgatgcgaaggacagcattatgaataaaatacagcagcttggtgaaacgacgcttccgcagctgccccaagatacaaatattcattgtctgaccattatcggacaaattgaaggccatgttcagcttcctccgcaaaacaaaacaacaaaatatgaacatgtcatcccgcagattgtggcaattgaacaaaatcctaaaattgaaggcttgctgatcatattaaatactgtcggaggagatgttgaagctggtcttgcaatagcggaaatgcttgcatctttatcgaaaccgaccgtttctatcgtgcttggcgggggcattcaatcggcgttccgattgctgtatcctgtgattacagctatatcgccgaaacagcaacgatgacgattcatccagttaggctcaccgggctggtcatcggggtaccgcaaacgtttgaatacctggataagatgcaagaaagagttgttaaatttgtgacaagccattccaatataaccgaagagaaatttaaagagctaatgttttcaaaaggaaacttaacacgggatatcggaacaaatgtggtcggtaaggacgcagttaaatacggattgatcgatcacgcaggcggtgtcggacaggcaatcaataaactgaatgagctcatcgacgaagcaaggaaagaagaaggacggatgattcaatgattctttataccgtgatgccgcaggaaattgtgtttgcagaacagaaccaagagacaagcgcacatgagcaaattgaatataaaggtgtaccgcttctagtcgaaatgaaagggaatgaagcggaagtcattcaaatcatgagcaccaatccaatgcattttctgcatccggacatttcaccgggacaaaagctgaaattaaacgtataagaatccaaccctttttaaagggcaaaatatgctataataggggaatcctacagaaaaaacgcagcctgtaaacggctgctttcttcattatgtatgaacttacattttttaacgcagtaaggtgatgagtatggcaaagaaaaaacgaaaattaagaaaaaaacaggcgaaacagctcaatataaaatacgagctcaacggattgctgtgtatagccatttcaattatcgcaatcttgcagctgggggtagtcgggcaaacgtttatctatttgttccgcttttttgctggagagtggtttattttatgcttgttaggtttattggtgttaggagtctcactgttttggaagaaaaaaaccccaagccttttaacgagacgaaaggccgggttgtactgtattatcgcaagtatattgctgctttctcacgtgcagctatttaaaaatttgacgcacaaagggtctattgagtctgcaagcgtggtgcgcaatacgtgggaattgtttttaatggacatgaatggcagctctgcttcacctgatttaggcggaggaatgatcggtgcgctgctgtttgcggcttcacactttttgtttgcgtcgactggttctcagatcatggcaattgtcatgattttgatcggaatgattttagtaacaggacgctcgctacaagaaacgctaaaaaagtggatgagcccgattggacgttttataaaagaacaatggttagcatttattgatgatatgaaatccttcaaatcaaatatgcagtcatcgaaaaaaacgaaagcgccgagcaaaaaacaaaaaccggcccgcaaaaaacagcaaatggaaccggagcctcctgatgaagagggggattatgaaacagtatcgcctcttattcattcagagccgattatctcaagcttttctgatcgtaatgaagaggaagagtctccagttatagaaaagcgcgccgaacctgtgtcgaagccgcttcaggacatccaaccggagacaggtgatcatgaaactgtttctgctcctcctatgacctttacagagctcgaaaataaggattacgagatgccgtcactggatttgctggcagatccgaagcataccggccagcaggctgataaaaagaatatttatgaaaatgcgagaaagcttgaacgcacattccaaagctttggcgtaaaggcgaaagtcacacaggttcatctcggaccggccgtaacaaaatatgaagtatatcctgatgtcggagtgaaggttagcaaaattgtcaatttaagcgatgatttagcgcttgcgcttgctgcgaaggatatcaggatcgaagcgcctataccaggcaaatcagcaatcggaattgaagttccaaacgcagaagtggcaatggtttcgctgaaggaagtgctggagtctaaattgaatgacagaccggatgcgaagctgttaattggactcggccgcaatatttcaggtgaagctgtattggctgagttaaacaagatgccccaccttttggtcgcaggcgcaaccggtagcgggaaaagtgtctgtgtcaacggcattattacaagtattttaatgcgcgcgaaaccgcatgaagtgaaaatgatgatgatcgatcctaaaatggtagagctcaatgtctacaatgggattccgcatttgcttgctccggttgtaaccgatccgaaaaaagcgtcgcaggctttgaaaaaggttgtcaatgaaatggagcggcggtacgaattattttctcatacgggtacaagaaatattgaaggatacaatgattatataaaacgcgccaacaatgaagaaggagcgaaacagccagagctgccctatattgttgtcattgtggacgagcttgccgatctcatgatggtcgcttcatccgatgtggaagattcgattacgagattgtcccaaatggcgcgggctgccggcatccatcttattattgcgacacagcggccatcggtggatgttatcacaggggtgatcaaagcgaacattccgtcacgaatcgcgttcagcgtatcttcacagacggattcaaggaccattcttgacatgggtggcgctgagaagcttcttggccgcggcgatatgctgtttttacctgtaggggctaacaaacctgtccgtgtgcagggagcatttttgtcggatgacgaagtggagaaggtcgtcgaccatgtgattacgcagcaaaaagcgcaatatcaagaagaaatgatccctgaggagacaacggaaactcattccgaggttactgatgaactttatgatgaagctgttgaattaattgtcggcatgcagacggcatctgtttcaatgctgcaaagaagattcagaatcggctatacgagagcggcgcgcctgattgacgcaatggaggaacgcggtgttgtcggaccgtatgaaggcagcaaacctagggaagtattattatcaaaagagaaatatgatgagctctcttcttaatgaagggagttccgctttctatagtcgtcaataataacattatgtaaactgatcacctttctatttattttttcgacaaaacatgatatagttgtcccaattgttcaataatttttatcgaaagtggtttacggaggggaaacatgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttgcggatactggaagaagagcatgtgattatcagaaggcatggtgtaggcacttttgtccattctaagccgttatttctttcgggcattgaacagctaaacagtgtaacgaagatgatagaacaggcgaatatgacccctggcacgatttttctatcatcacaagtgcttatgccgtctgaagatgatacgaagagatttcatttggcagaagggcaagaacttttttaccttgaacgagtcaggacagctgacggacagccgattgtgtattgtatagacaaaattccgatgaatattttgccgaattctttttctcatcagcaagaatctatgtttgacctgcttgagaaaaattcaggctccgtaatcagctatgcagtaactgatatagaaccgatcggctatcacgataccatttctcccgtacttgaatgcgatccggaaacagctcttttgctgttaaaacaaacccattacgatcagcacgataaaccggtgctttattctttaaattattttagagcggataaattcagatttcatgttttgcgtaaacgattctaaaaacggacgcctgtatgtgtctgtttttttatttgcactgattcatgtttctttgtacatactttcattccggttaacgcaatatataagggatgacaagaaagtgaatgggtgaaaatgttgagagagaaaaatggaatgaaaaatattattgcattgtcttccgtcccgcttgtgatgacactcgggaactccatgctgattcctgttcttccgatgatggagaaaaagctgtctgtgacttcatttcaagtgtctttaatcattactgtatactcagtagtagcaattatttgcattccgattgccggatatttgtcggatcgtttcgggagaaaaaaaatattgcttccatgcctcctcattgcaggattgggggagccgtagctgcttttgcctcgacctatatgaaaaatccttatgctatgatcttggcggggcgggttcttcaaggcattggttctgcaggtgccgctccgatcgtcatgccgtttatcggcgacttgtttaaaggagacgatgaaaaggtcagcgctggtcttggcgatattgaaaccgccaacacgtcagggaaggtactgagtcccatacttggagccttgctggcttcttggtattggtttgtaccgttttggtttattccgtttttctgtttgatcagctttttgctcgtattgtttttggtggccaagcctgaagaagatgaagatgcgcctgctgtttctgagtttattaagagtgtgaagaaaatctttaaacaagatggtcgttggctttatacggtcttcattatcgggtgcgtcattatgtttttgttatttggcgtattattttatttatcagatacgctggagaacaagtatgccattgacggagtagctaaaggcggattactggcaatcccacttttgtttttgtcaaccagttcttttatagctggcaaaaagatcggtaaagataaaggccgaatgaaattttgcgttgttacaggaatgattctgttaaccctttcgtttattgccttgtggtggaaccacagtttttattttttatttgtctttttaagctttggcgggattgggattggaatggctcttcctgctttagatgcactgataaccgaagggattgaaagtgaacaatgcggaaccatttcctccttctacaatagcatgcgctttataggagtagctctcggtccacctgtttttgctgcattaatgtctaatgcaaactggattattttcatactctcggcgttttgcagcatcgtttctttatttttagtgctctttactgtagatgctaaaaaaagtgaagaagaagaaaaaaacttagggacggtctagccagccgtctttttttgcgctttcttgcacagtttacaactgtacctatacagcattcggaggttattgtttccttataaatcctacagttgctataattacatgaaagagtgtttctgcgaatgctgaaaattggtcataatacatactaattaagaaatgaacgaaggaggttccatatgtcatatgttaatgaactcaaatcaaagcacggcggtttaaccgcacacattgtagaaacagaaaaattcaaaaccgtctcgcttatttttaagatgctggcaccgctgacaaaggatcaagtcaccaaaagagcgctgcttccgcatgtgcttcttcgcggaacgaaaagccatccgaaaaccgcagaattgcgttcatacctggatgagctgtacggcacgtcagtatcggctgatcttacgaaaaaaggagagcggcacgtcattacgttcaggcttgaaatcccgaatgaaaaatatttaaaagaccaaacgccgctacttgagaaagggctccagcttcttgcagaaatcgtcttttcacctgctttagagggagacgcttttcagtcacaatatgtggctcaagaaaaacggacgcttaagcaaagaatccaagccgtctatgatgataaaatgcgctattcgaatttaaggctgatacaggaaatgtgcaaaaatgagccttatgcgcttcatgtcaatggtgaaatcgacgatgtcgatgacattacggcagagcaattatacgaaacataccaaagcgctatccaaaaagaccagcttgatctatatgttgttggcgatgtggacagtaaccaggtacaatcggcaatcgataagtatttcaaaacagaagagcgcactcttggcacgattgaaaacaatcacgctgatgaaaaagttcagccaaaagaagtaattgatgaagaggatgtcaagcaaggaaagctgaatatcggctaccgcaccagtatcacttatacagatcaggattatcctgctttacaagtgtttaacggattgttcggcggattctctcattctaaacttttcattaatgttcgggaaaaagccagtcttgcttactacgcggcttcccgtatagaaagttttaaaggcttgttaatggtgatgtcaggcattgaagtgaaaaattttgaacaggctgtttcgattattgctgagcaattccaggcaatgaaaaacggcgatttcagtgagcaggatatagcacagacaaaggccgtcattcgaaatcaagtgctggaaacgattgatacagcatacggtttatctgaatttttatatcagcaggccgctgctcaagtcgagattcctatcgaagactttcttgccaatattgagaatgtcacaaaagaggatatcattaaagccggcgaaaagattcagcttgatacgacttatttcttaaaagggacggagggtgcatcttgatcaaaccaatcgaatatgaacagcttcaggagacgctgtatcatgaaaaaatgtccaacggccttgatgtttacgttttgccgaaaaaaggcttcaacaagacatatgcggtctttacaacaaagtacggctcgatagataaccggtttgtccctttaggtaaaaatgagatggttcacgtgccggacgggattgctcactttcttgagcacaagctgtttgaaaaagcggacggagacgtttttcaagatttcagcaaacagggggcttctgccaatgcgtttacgtcatttacaagaacagcttaccttttctcaagcacatcaaatgttgaacgcaatttagagacgcttatcgatttcgtacaggacccatattttactgaaaaaacggttgaaaaggaaaaagggattatcgggcaggagattaatatgtacgacgataaccctgattggaggctttacttcggggtcattgaaaacatgtacaaagagcatcctgtcagaattgacatagcgggaacagtggaaagcatttcacatattacaaaagaccttctttatgaatgctatgaaacgttttatcacccgagtaacatgctccttttcattgtcggacctgtagatcctgaagcgattattactcaggtaagagaaaaccaggagaaaaagccgtataccgatcagccggagatcaaacgggaagaagtgaaagagcaagaagcggttttccgaaaagaaaaagagatcaaaatgaacgtgcagggaccgaaatgccttgtcgggctgaaatccaaaaagccgtttaaattaggcaaagagctcttaaagcatgaactttcaatgaacttattgcttgaagctctttttggcaaaagctctgcccagtatgaatcactttatgaaaaaggatatattgacgaaacgttcagctttgattttactgctgaatatgggttcggttttgcggcgatcggcggagatacgcctgagcctgatcaattggctgaagacatttcaagcatgcttttgcgcgccggtgaactgattactgctgaaaagattgaacttgccagaaagaaaaagatcggcacattcttaaaagcgctgaattcccctgaatacatcgccaatcaatttacccgttatgcgttcttggatatgagcctgtttgacgttgtaaccgtactcgagcagattaccctcgaggatgtccagaacgtaatacaagaggaaatttctgcagacagactgactgtctgcaaggttgttcctaaatcataaacaaaacatccctccagtgtgaggggtgtttttctgcggaaagaaggaaagaggatgaacaaaacagcactaatcaccggagcaagcggcgacattggcaaaagcatcagcgaaacccttgcagctagagggtacaatctgctgctgcattacaatacaaatcaaaacgcggcagcggagcttgctgaaaaactaagtgagatgtttggcgtaaatgctgagatattacaagctgatctgtccgcgcaagatggggcagataagctgacaagttcaattgttcagccgattgatgcgattgttttaaacagcggaagaagccattttgggctgattacggatgtagataacgcaacggtccaggaaatggttcagcttcatgtggcgagtccgtatatgctgacgagaaaccttctgccaggcatgattcggaataaatcgggagcgattgtggctgtcagctcgatttggggagagactggagcatcctgtgaagtgctgtacagcatggcaaaaggagctcagcattcgtttgtaaaaggattggctaaggagctggcgccaagcggaatcagagtaaacgccgtagcgccgggcgcagttgatacaaatatgatgaatcaattttccccggctgaaaaagaagagatcgctgatgagattccgatcggccggctggcccggccgcaagaaattgcggatgcaacagcttttctcctgtctgaaaaagcgtcatatatcaccggccaaattctgtcggtcaatggcggctggcactgctgatccgaaaatattcggtgtatagtttcttttgcgaaggacacaataatcttgtaacttcacatgaaatggaggaaacaagcatgtcagtattagaaaactgggatagctggaaaaacttccttggcgaccgtctgaactatgcgcaagataaaggtatgagccaggatacgattacagatcttgcgacagaaatcggcagctacttggctaatgaagtggaatctaagaacgagcaggaaaaagtgctggcagatctttggagtgtagcatcaaaagatgaacagcacgccattgccaatatgatggttaagcttgttgaaaataacagcactcactaggaagagaggggatttttcctctcttttttatgttttcctcatcacagcaacattcttctttctaattagagaaaaatgctttatgataaaggaaggtaaaattttgccacaatgaagggggtatatcatttggcaaagctcgaatggtattttgaatatgaaattcaagtgaaccgccccggactgctcggggatatttcgtctcttcttgggatgctttctatcaacatcgtaacgataaacggcgtcgatctttccagaaggggaatgctcctcaggtgccgccatatagatcaaattaaacgattagaatcaatcttaaaaacgatggaaacaattaaagtaacgaagcttagagaaccgaggcttcgcgaccgtcttgccgtacgccacggccgttatattcaacgggatgccgatgacaagaaaacgttccgctttgaacgggacgagcttggcttattagtcgattttatggccgaattgttcaaaaaagaaggccataaattaatcggaatcagaggtatgccgcgtgtcgggaaaacggaatcgattgtagcctctagtgtgtgtgccagcaaaaggtggctgtttgtgtcatcaaccttgctgaagcagacgataagaagccagctgattgccgatgaatacagcactgaaaatgtctttatcgttgacggaattgtgtcaacacgaagaggatcggaacgccatctccagctggtccgagaaatcatgcggcttccggcaacaaaagtggtggagcatccggacatattcgttcaaaatacagagtatacactagatgactttgattatattattgaactgagaaatgaccctgatgaggttattacatatgaacatgccgaggaaccccaaatgtttgatcaatccgggttttcaagctttgatttttaaaattggaaggtgtttgttgtgactgaactaggaatccggctcaaagaagccagagaggaaaaagcaatgtcattggatgatctccaagcggcaacaaagattcaaaaaaggtatttaaccgccttggaggaagggaactatgacattattccggggaagttttatgttcgggcattcatcaagcaatatgcagaagccgttgggcttgatgcggatcaactgtttgaggagcataaaaaagatatccctaatacgtatcatgacgatgtgtctgaaaagatctccggcatgaatcttcaaaaggaaatgccaaagccagcatctaaggcgctggagctgctgccaacgatacttgttattctcggcgtgattgtcgtgattgccattgtgtacgcgatcattcagtttgcgaatcacaaaagcagtgatgatcacaatgcggcatcagaaaaagcaattacgcaaagtgagagcaagtacgaaatccctaaagattcaacgctgaaagagaatcaaaagaacagctctgaaaaagagacagacactaaaaaagaaacgaaagaaaacgaaaataagaaagaagaaaatgacagtgataagctggagattaaagctgctggcactgaaggatcgttaacgacttatgaagtatccggcgctgataaaatcgagctggaactgaaggcatcagacagctcctggattcgagtgcgcgatgaaaacagcagctctttaaaagaaggaacgctgaaaaaagacgaaacctataaaaaagacataactgatcagaaacaagttgatatccgcactggatatgcacctaatctgaaaataaaaatcaacggtaaggttctttcatatgaacttgatccgaaaaaagtgatggcacaaaccataaagattgtaaataaaaaggaagaaaagtcatcttaattaccagatgacttttcttcacgtccgagtatgaaattggaggggctttatgtttaacttaccaaataaaatcacactagctagaatcgcattaatcccaatcttcatgattatcatgctggcgccgtttgactggggcaggctcgaagttggagacgaatcgatcccggtcgcacatttggcggggccattctatttattattgcatctacaacagactgggtggacgggtattatgcccgaaaattgaatctcgtaacaaacttcgggaaatttcttgatccgcttgcggacaaactgctcgtatccgcagcgttaattatccttgttcaatttgatctcgctccagcttggatggtcattgtgattatcagcagggagtttgccgtgacaggtttaaggcttgtcttagccggaacaggagaagtcgtagctgctaacatgcttggtaaaatcaaaacctgggcacagattattgcggtatccgcattgcttcttcataatcttccatttgaacttgtgtcattcccgtttgcagacttggcgctgtgggtagccgtcttctttactgtcgtctcaggctgggaatatttctctaaaaattgggaagcgttaaaaacatctaactaagaaagaaggacttcgtcatggaatttccaaaaaaagcagaaataattgcagtcggttcagagttgctgcttggtcaaatcgccaatacaaatgctcaatttatcagcaaacagctcgctgaaatcggggtcaacgtattttatcatacagcggtcggagataacccggagcggctgaagcaggtcatcagcattgctgaagaacgctctgacttcattattttttcaggagggcttggacccacaaaagatgatctgacgaaagaaacgattgcaaatacgctgggacgtccgcttgtgttaaatgatgaggcattccaatccattgaggactatttcaaacgaacaaaacgcacgatgtcacctaataaccgaaaacaggcgcttgtgatcgaaggctctgacgtgctggcgaatcactttggaatggccccgggaatgctcacagagcatgaatcgcgctattatatgcttcttcctggaccgccgagcgaattgcgtccaatgtttgaaaacgaggcaaagcctcttctgctgaaaaagatgggttcaaatgaaaaaattgtgtcaaccgttcttcgctttttcggtatcggtgaatctcagcttgaagccgatttggaagatattattgatgcacaaaccaatccgacaattgcgcctttggcggctgatggagaggtgactctgcgtctgacagccaaacacgccgatgaaaaggaaacagagcgtctgttaaaagaaacagaggccgttatcttagagcgtgtcggtgaatttttctatggttacgatgatacttctcttgtaaaagagctatctatagcgtgtaaggaaaaaggcataacaatttctgcggcagaaagctttaccggagggctgttttctgaatggctgacggatcatagcggtgcctcaaaattatttgccgggggcgttgtttgctatacaaacgacgtgaagcagaatgtgcttggtgtcaagaaggaaacattagatcgttttggggcggtcagcaaggagtgcgcatccgaactggctaagggtgttcaaaaactcactggcagcgatatcggcattagctttactggtgtagcaggacctgatgctcaagaagggcatgagcctgggcatgtgtttatcggcatttccgcaaatggtaaagaagaggttcacgagtttcactttgcgggctccagaacggggatcagaaaacgcggcgctaaatacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtaccaagcggctccctcgctcttgatacagcactgggaattggcggatatcctcgcggacggattattgaagtatacggtcctgaaagctcaggtaaaacaactgtggcgcttcatgcgattgctgaagttcagcagcagggcggacaagccgcgtttatcgatgcggagcatgcgttagatccggtatacgcgcaaaagctcggtgttaacatcgaagagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattcgcatgtcggtttacaagcacgcttaatgtctcaagcgcttcgtaagctttcaggggccattaacaaatcgaagacaatcgcgattttcattaaccaaattcgtgaaaaagtcggcgttatgttcgggaacccagaaacaactcctggcggccgtgcgttgaaattctactcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttagataataacggagtagtgcagcagcaagctgaagagacacaagaagaactcgaatttgaagaataaaaataaaataagtttcaaatgatacaaaaggctgagtgaaaaactcagcttttttgtattttgcaaaaaaatgataaaaatattgctttttttgacaacttttttatggctttattcgtctaacaaaacgtgtgcaaaatggaatttattttgggaggaaaaaatgaatgacaagcccaacccgcagaagaactgcgaaacgcagacggagaaaactaaataaaagaggaaaactgttgcttggtcttttagcagtgatggtttgcattacgatttggaatgctcttcatcgaaatagtgaagaaaacgaaccatctcaagaaactgcagcggtttcaaataccgatcagaaaaaagaggtcaaaaagaaaactgccaaaaaatcagaggaacaaatcaaaacagtggatcgaaaccaaaaaatcagcaattatttagaagagatcggtttcagcggaacagccatgattgtcagaaatggagaaattgtaacaaataaaggttttggctatgctgaccgtaaacactacattcaaaataatccattgacatctttttatgtcggttcatcacaaaaagcgctgattgcaactgctattttgcagcttgaggaaaaggggaaacttcagacaagtgatccggtaagtacgtatttacctcattttcctaacggacaaacgattactttgaagaatctgcttacacatacatcggggataaacggacatattgaaggaaacggcgccattacgccggacgatttaataaaagacatagaactgcagggaatcaaacgtcagccgggcgtatgggactacaaggattccaactattctgttctcgcttatattattgctgaagtaagcggtgagtcctatgaacagtacataaagaatcatatttttaaacctgcgggaatgacgcatgcaggcttttacaaaacatatgaaaaagaaccttatcctgctgtcgggtataagatgaagggcggcaaaacagttacaccgtatatacctgatctatctcagctgtatggagccggtgatatttatatgagcgctatagatatgtacaaatttgaccaagcgctgatagacggaaaactgtattcgcaaaatagctatgaaaagatgtttacgccagggagcagctccacatacggcatgggattttatgttgctcccggaagctattcaaaccatggtgttatgccgggcttcaatatcttgaacagctttagcaaatctgggcaaaccattgttattttgttctcaaacattcaaaataatgctaaattgggccaagtgaacaataaaatataccagcttctgaatcaagaatgattggcgttcttcttttggatgaattgcattcggaacgtgaaaagacgactggcctgcaaacgttaagatggcaagcttgacaagtatttccgacacatttacaatgaagttgtaacatttgtttttttaacatgattgttaaaccatttaaacttgacaagggcgatgaacacactcattccctgtgaaggttctgtatgttgagaaaactagacaatgtacatgccgacactttttaagcaacaaccaagttcatagcaagaggaggtgaaagtatgaccccaattatgatggttctcatctccattttgctgattctactcggtttagttgttggctactttgttcgtaaaaccattgccgaagcgaaaattgcgggcgcacgcggtgcagccgagcaaattcttgaagatgcgaagcgtgatgctgaagcactgaaaaaagaagctctgcttgaagcaaaggatgaaatccacaaacttcgaatagatgctgaacaggaagttcgtgaaagacgaaatgagcttcaaaaacaagaaaaccgtttactccaaaaggaggaaaaccttgatcgcaaacatgagggaattgataaacgggaagcgatgttggagaagaaagatcattctctgaatgaacgacaacaacatattgaagagatggaaagcaaagtggatgagatgattcgtatgcagcagtcagagttggaacgaatttcgagtctgactcgtgatgaagcaaaacaaatcattcttgagcgggttgaaaacgagctttcacatgacatcgccatcatgacaaaagaaactgaaaaccgtgcgaaagaagaggcggataagaaagcgaaaaacattctttcactcgccttacagcgctgcgcagcggaccacgttgccgaaacaacggtatcagttgtcaatcttccaaatgatgagatgaaaggacgtatcatcggacgggaagggcgtaacattcgtacgcttgaaacgctgacaggaattgacctgattattgatgatacgcctgaagctgtcattctttccggatttgatccgatcagacgtgagacagccagaattgctcttgataaactcgttcaggatggccgtattcatccggcacggattgaagaaatggttgaaaaatctcgccgcgaggtcgatgactatattcgtgagatgggtgagcaaacgacatttgaggttggcgttcacggcctccacccagatctcatcaagatcctcggccgcttaaagttccgtacaagctacggtcaaaatgtgcttaagcattccatggaagtcgcattcttggccggtctaatggcatcggagcttggtgaagacgcaaagcttgctaaacgtgcgggtcttcttcacgacatcgggaaagcaattgaccatgaagtagaaggaagccacgttgaaatcggggtagagcttgcgaccaaatataaagagcacccagtcgtgattaacagtattgcatcacaccacggggatgaggagccgacttccattatcgctgtgctggtagctgcagcagatgcgctttccgctgcaagacctggcgcaagaagtgagacgctcgagaattatattcgaagacttgaaaaactcgaagaaatttctgagtcctacgaaggtgttgaaaaatcatttgccattcaggctggacgcgaagtgcgtattatggtgaagccggattcaattaatgatcttgaggctcatcgactggcgcgagatatccgcaagcgaattgaggacgagctcgattatccaggtcatattaaggtgacagtaatcagagagactcgagccgtagagtatgcaaaataaagtgatgcgctaagcatcactttatttttttgacgacaaggaattttcaagaagaaaggatttacaaaatgagaattttatttatcggagatgttgtcggttcaccgggccgtgacatggtcaaagaatatgtaccaaagctaaaaacaaaatataagcctcactttaccattattaatggtgaaaacgccgcacatggaaaaggcctgacggaaaaaatttatcacagcctaatccagtccggcgcagatgcaatcacaatggggaaccacacatgggacaaaaaagaaatatttgattttatagatgacgttccgaacttggttcgcccggcaaactttcctgaaggaacaccgggaaagggatcacatatgtgaaagcaaacggcaaagaactagcagtcattaatttgcagggacgtacgtttttgccgccgcttgatgacccgtttttaaaagcggacgaattgatcgcagaagctgcgaaaagaacaccgtacatttttatcgactttcatgccgaagcgacaagtgaaaagctcgcacttggctggtacacggatgggagggcgtcggctgtagtaggaactcatacacacgtgcaaacagcggataaccgcattttgccgaagggaacggcatatattactgatgtgggaatgactggcccgtatgatggtatactggggatggacagagagacgattattaagcgattcaaaacgaaccttccagtccggtttactgtcgctgaaggaaaaacaacgctcagcggagttgtcattgacattgacgatcaaacgaaaaaagccgtgaaaattgagcgtattttaatcaacgatgatcacatgttctttgaatagttgaacatatggttattttataaaaatattaaaaagaaaagcaggaatatagcaactccttagtgaatatagtaaaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcgagtccaaattcagtggcaggtgcgcttgcaggcgtgttgagagagcgaggagccgccgagattcaagcgatcggagcgggtgcattaaaccaggctgtaaaagctgtggcgattgccaggggatttgtggcgcctagcggcgttgatttgatttgtattccggcttttacagatattcaaatcgatggggaagaaagaacagcgattaaattaatcgtggagcctcgctaaaaacaaataaagcattctcaacctgtttgcgtaatgcaaacaggttgtttttcatttattgtgatattttctcccaatagtatttttagcacataaatgagcgaatatacaaaatcagaaatgagctaaaacgtttcaaaaaaaattccgctcatttttcaagacagatacttttgtccttctggagaagacagtgctgtttacgcttattccatatcatggtacaatccgaatataacaagaatttttcaaggaggattgtacatgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagaggacgtgggagagaatgtcagcagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcggagtatgtaaaagttccagctgataacatttggagaaatcccgctgatatggacccgtcgattgcttccattcaagagcctttaggaaatgcagttcataccgtactcgagagccagcctgcaggaggaacgactgcagtcattggatgcggaccgattggtcttatggctgttgcggttgcaaaagcagcaggagcttctcaggtgatagcaattgataagaatgaatacaggctgaggcttgcaaaacaaatgggagcgacttgtactgtttctattgaaaaagaagacccgctcaaaattgtaagcgctttaacgagtggggaaggagcagatcttgtttgtgagatgtcgggtcagccctcagcgattgcccaaggtcttgcgatggctgcgaatggcggaagatttcatattctcagcttgccggaacatccggtgacaattgatttgacgaacaaagtggtatttaaagggcttaccatccaaggaataacaggaagaaaaatgttttcaacatggcgccaggtgtctcagttgatcagttcaaacgtgatcgatcttgaacctgttattacccatcagtttccgttagaggagtttgaaaaaggtttcgaactgatgagaagcggccagtgcggaaaagtaattttaattccataaagggggataaacatgacgaaggaatttgattttttaaaagcagagcttgatagtatgaaagaaaaccatacatggcaagacataaaacagcttgaatctatgcagggtccatctgtcacagtgaatcaccaaaaagtcattcagctatcttctaataattacctcggattcacttcacatcttagactcatcaatgccgcacaggaggccgttcagcagtatggagccggcaccggatcagtgagaacgattgccggtacatttacaatgcatcaagagcttgagaaaaagctggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggccttgacggcagagttcatattcaggtcggaacattaagcaaggcaatcggagtgctcggcggctacgctgcaggttcaaaggtgctgatcgattatttgcgccataaaggccgtccatttttattcagcacatctcatccgccggctgtcactgcagcttgtatggaagcaattgatgtcttgcttgaagagccggagcatatggagcgcttgtgggagaatactgcctattttaaagcaatgcttgtgaaaatgggcctgactctcacgaagagtgaaacgccgattcttcctattttaataggtgatgaaggtgtggcaaagcaattttcagatcagctcctttctcacggtgtttttgcccaaagtatcgttttcccgactgtagcaaagggaaaagccagaattcgcacgattataactgcagagcacaccaaagatgaactggatcaggcgcttgatgtcatcgaaaagacggcaaaggagctccagctattgtaacaagaggaagagtttactcttcctcttttgattccttattgattattattctcaatgagtgtacaatgataggttgccagttgtgcagagcttcaataacctttatactgaagggtggaagtttggtttgaaaggagaaaatatgacatgaatgaaaaacaaaaattagagagcggacaagttaatccatcggacaaaaaatccgagaaggattacagcaagtactttgaagctgtttacattccgccttctttaaaagacgcgaaaaaacgaggcaaggaagccgttacttatcataatgactttaaaatttctgaacaatttaaaggattgggagacggaagaaagttctatatccgtacgtacggctgccaaatgaatgaacacgatacagaggttatggcagggatctttatggcgctcggttacgaagcgacaaactctgttgacgatgccaatgtcattttgttaaatacatgtgcaatccgtgaaaatgctgaaaacaaggtgtttggtgagctcgggcacttaaaagcactgaaaaaaaacaatcccgatctgattttaggcgtgtgcggctgtatgtcccaagaggaatcagtcgtgaaccgtattttgaaaaaacatccgtttgtcgatatgattttcggaacgcataacattcatcgcctgccggagcttttgtcagaagcatacctttcaaaagaaatggttgtagaagtttggtctaaggaaggggacgttattgaaaaccttccgaaagtccgaaatggaaaaattaagggctgggtcaatatcatgtacggctgtgacaaattctgtacgtattgcattgtgccttacacacgcggaaaagaaagaagccgccgccctgaggatatcattcaggaagtgagaaggcttgcaagtgaaggctataaggaaattacactgttaggccaaaatgtaaacgcgtatggaaaagactttgaagatatgacttacggacttggtgatttgatggatgaactgagaaaaatcgatatcccgagaatccgttttacaacgagtcatccgcgcgactttgacgaccgcctcattgaagtgctggcaaaaggcggaaatctgcttgatcacattcatcttccggttcaatcaggaagctcagaagttctcaagctgatggcccgcaaatatgacagagagcgttacatggagctggtgcgaaaaattaaagaagcaatgccaaacgcttcattgacaacggacattatcgtcggatttccaaatgaaacggacgaacagtttgaagaaacgctttctctataccgtgaagtggagtttgacagcgcctatacgttcatttactctccgcgtgagggcactccggctgctaagatgaaagataatgtaccgatgcgtgtgaaaaaagaacgcctgcagcgtctgaacgcgctggtgaatgaaatttctgctaaaaaaatgaaggaatacgaaggcaaggttgtcgaagtattagttgaaggtgaaagcaaaaataaccctgatattcttgccggctatactgaaaaaagcaagctcgtcaatttcaaagggccgaaggaagccatcggcaaaatcgtccgcgtgaaaatccagcaagcgaaaacatggtcgcttgacggagaaatggtaggagaagcaatcgaggtgaaatgagatgacgctctactcaaaaaaagacattgtgcagcaggcacgaaaccttgcaaaaatgatctctgaaacagaagaggttgattttttcaaacgggctgaagcgcaaatcaatgagaatgacaaagtgtccacaatcgttaatcagattaaagccctgcaaaagcaggctgtcaatctgaagcattatgaaaagcatgaagcgctcaaacaagtagaagcaaaaattgacgcgctgcaagaagagcttgaagagattcctgttatccaggaattcagagactcgcagatggaggtaaatgacctactgcagctcgttgcacacaccatttccaaccaagtcacaaatgaaatcatcacatcaaccggaggcgacctgctgaaaggggaaaccggttcaaaggtgaagcattcaaataacagctgttctctctaaacacggtgcctttacaggcccgtgtttttttatcatttgtgcggttaaaaatgaactaaataatctatgtaccaaatgttcaattggtttttctgtgctcagccgcgtataaactttatcgcacttataagtaaagtttctaggcacccctgcatacaatggaacagaaactttgtatttttatattttatttataaaaatgcacactagacaaatgcccagcataagataacacgaagaagaacaaggaggcatgccggaatgtctgaatacagggaaattattacgaaggcagtagtagcgaaaggccgaaaattcacccaatgcaccaacaccatctcgcctgagaaaaaaccgagcagcattttgggtggttggattattaaccacaagtatgacgctgaaaaaattggaaaaacggtagaaattgaagggtattatgatataaacgtatggtactcttacgcggacaacacaaagacagaggttgtcacagaacgggtaaaatatgtagatgtcattaaactcagatacagagacaataattacttagatgatgagcatgaagtgattgccaaagtgcttcagcagccaaactgccttgaagtgaccatttcaccgaatggaaataaaatcgttgtgcaggcagaaagagaatttttggcggaagtggtaggggaaacaaaggtagttgttgaggtcaatcctgactgggaagaggatgacgaggaagattgggaagatgagcttgatgaagagcttgaagacatcaacccggagtttttagtgggagatcctgaagaataaaaaagggactaggggagacagtacccccaagtctcttttttatattgatatatcattcttttatcactttttgtttatgttataatgaaggttggaaaatagaaacgttgatacatagtgagggattaaacaatggccggttatacgcctatgatacagcaatatttaaaaataaaggcagagcaccaggatgcctttttattttttcgcctgggtgatttttatgaaatgttttttgaggacgccaaaaaagcgtcacaagagctggaaattacgttaacgagcagagacggcggtgcggctgaaaaaataccgatgtgcggtgtgccgtatcattctgcttccgcgtatatcgaacagcttattaaaaaaggctacaaagtggcgatctgtgaacagacggaagatccgaaagccgcaaagggcgttgtgaaaagagaagtggttcagcttattacgcccggaactgtaatggacggcaaaggcatccatgaatcggaaaataactttatcgcatctgtttcagcctgctcgaacggatacggacttgcgctgtctgatttaacaacgggagaaaatttggctgttttgattgaacggcttgaagacgtcatatcagaaatttattccgtcggcgcacgggaaatcgtggtttcaggaagcttggatgccgatacagtggcacagctgagagagcggtgcggtgcaacgatttcaattgaagacggagaaacagacgaacacgtaacgatcattgagcacttaaataatgaagatataacaaaaacatttctgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgatccgttcaaaaaataaaaaaggctcccttttgtggctgctggatgaaacaaaaacggcaatgggaggccggctgcttaaacagtggattgaccggccgcttatcagagtcaatcaaatcgaagagcgccaagaaatggtggaaacattgatgtcccatttctttgaacgggaagatctgcgtgaacgtttaaaagaagtatatgacttagaacgccttgccggacgcgttgcattcggaaatgtcaatgcccgggatttgattcagctgaaggaatcgttaaagcaagttcctggcatcaaacagctggttgcttcactggctcatgacaaggccaaggaacgtgcagagcgcattgatccttgcggggatgtacttgaactgctggaagaagcgctgtacgaaaaccctcctttatctgtaaaagaagggaacctgattaaagatggttataatcaaaagcttgatgaatatcgtgatgcaagcagaaacggaaaagactggattgcccgcctggaacagcaggagcgggaatacacaggcattcgctctttaaaggtcggctttaataaagttttcggttattacattgaagtgactaaagcaaacttgcatttgcttgaggaagggcgttatgagcggaagcagacattaaccaatgcagagcgctacattacccctgaattaaaagaaaaagaagcgctcattttagaggcggaaaataacatctgtgagctggagtacgagctgtttaccgagctgcgcgagaaagtgaagcagtatattccgcggctacagcagcttgcaaaacagatgagcgagctggacgcactgcaatgctttgcgacaatcagtgaaaatcgtcactacacgaaaccggagttctctaaagatgaagtcgaagtgattgaaggcagacacccggttgttgaaaaagtcatggacagccaggaatatgtcccgaacaactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgcttccgatttttgatcaaatttttacacgaatcggggctgcagatgatttgatttccggacaaagtacatttatggtagaaatgcttgaagcgaaaaatgcgattgtcaacgcgacgaaaaacagcctcattctgtttgatgaaatcgggcggggaacgtccacttatgacggcatggcgctggcacaggcgattattgaatatgttcacgatcatatcggcgccaagacgctgttcagcacacactatcacgagctgaccgttcttgaggacaagctgccccagctgaaaaacgttcatgttcgcgctgaagaatataacggaacggttgtctttcttcatcaaattaaagaaggtgccgctgataaaagctatggtatccatgtagctcagcttgccgaactgccgggagatctgattgcgcgcgctcaagatattttaaaagagcttgaacattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgctttcaaatcacttaatatactggatatgacaccgcttgaagcgatgaatgaaatgtacaagctgcaaaagaaattacattaaaacggggtgatgaatgtggcaaaagtcatccagctgtcagatgagctttcaaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattgcaagcgagctttccgccgccacgcaacgagtaaaataaaagatgaaaatgatttattcagggtgagaacgctcggtttcaggggagaagctctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagatgtggttaaccgtattgctctggcgcatccagaggtatcgatccgcctgcgccatcatgggaaaaacctgcttcaaacgaacggaaacggagatgtgcgccatgtactggcagcgatttacggcacggctgtcgccaaaaaaatgcttccgctgcatgtgagctccttggattttgaagtaaagggatatatcgccctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaacgtgcatccatcgaagcttgaggtccggctcagcaaggaaacagagcttcatgacttaatacgtgacggaattaaagatgtgtttaaacagcagcagctgattcctagtgcccaggtcccgaaaaaatcagcacctgccatcaaaaatgagcagcagtttataacctttgatgaaaagcctccggaaaaaaaagttccggaaaaatcgactgcgccatcttattcaccaatgaagctcagctcagtcgtgaaagagctggttgatgtggaggaagaattgcctcctctccaatttgatgctccacctatcgttgatcaggaacaaacccttgaggtgtccgatgtttcagaagaacagcctgaaacatttgagcaggaatgccatgaggaacagcagccagcgtctgagcgggttccaattatgtacccgatcggccagatgcacgggacttatatattggcacaaaacgaaaacggcctatatattatcgaccagcacgccgcccaagaacgtattaaatatgagtactttcgtgaaaaggtgggggaggttgagcctgaggtgcaggagatgattgtaccgctgacgttccactactccacaaatgaggctttgattattgaacagcacaaacaagagctcgaaagcgtcggtgtctttttagagtcattcggctctaacagttacatcgtccgctgccacccggcctggtttccaaagggagaagaagcagagctcatagaagaaatcattcagcaggtgctcgactccaaaaatatagatattaaaaaactccgtgaggaagcggcgattatgatgagctgcaaaggctccatcaaagcaaatcgccacctcagaaacgacgaaatcaaagcgcttctggacgacctccgaagcacatcagacccatttacatgcccgcacggccgcccgatcatcattcaccactcgacatatgagatggaaaagatgttcaaacgcgtgatgtagcgggggtggtaggcattgatccattctctgaatggatcaatgctttttttgtactccttcgagtgtcagattataagaaacggttgtaaacgtgtgagcagtgttaatgcattatacttcatggtccctccgtataacaaaatttccatttacaggcaattggaattaatgtatattttggatgagggggtggaaacacatggcatgtggtccgaagatcattatctttttggatgaacttgatgatccgaatgtaagaatcattttagaatgcagaatttaaattacaacattgtgttttgctccctgttcgtgtgaacagggagttttttcgtttatataactggtgatgtccaaatataaggtgttatgaattctccatatctgccatcggcattttaagctgcttctctattaggctggtcatcaaaagcaagttcagtgaaagccatcactgctgatatcacaacaagcaagatatctggaatataaatagactgcataaagtaatctgcaaaacagatcgttataagattgctgataaaatacagtataaaagcaaaaagtgcagtctttttcaatgaaagtgattttgccaaaatgatagagataatctttgtgagtgggtctatgattaaacctacagcaaagcaggctaaaataaataaagctaatgtttgattagaagcgtatgtgatgcccagtatggagaataagcctttcatcccgaagaaaaagccgccgaagatgactgcaagcgcaatggccgcgataaaagtgatagatacaattccgattaattttgatctgaggttaaaatctttagagtgctcgttctgttctttatggttcaagtatgacactcccttcacctgcttactcatacaaacagcacccttgaatcagcccaaaatatctataagtctgttttctgacgaaaatagtatagcatattttaacaaaaccaaaaaaggccctttccactggggaagggcctttttcatcatgttaactcctgagattcgccgaagctttctctttttttggccaaataaaatagctggctgtaatgagaaagtcaattcctataatgacagtccacagtttaagaatgccgctcaatgcttcggttcgggcagagtcattgataaaatagatcatccctgccaatagtcccgcaccaattaagtaggccagcacatgtcttagccagcctttcgcaccgtgcttggcatggtccattccaaaacgtttcagtggttttgttcctttttttgtcacataatattgaaacttttcatctgcccattgaatcatttgtttcccataagcgatcgatataccgatgtaaacagctgcaatcccatgggctgcggtcgctgaggctccgcggtaaaggtccacaccagttgccgctaacaagatcaaatcgataactggagttaaggcaaggaatagcagtcctaatgtatgtcgtttgaatacgtagcgtacagcaagccccaaaacaatgacaacccaaaacgcaatttcacagaaaacaatcatccatgcgataccgttcaatccattcccctcttttcaatacagttgtattatttaaataatatgttaccatctttatttttgtaacacaactgtattataaaaattgctctctcatttttttcttgttacaataaagctatgccaaaacaaattgaccatgagaaaagaagaaaacaaattgcagaagcaacgtggcgcgtcattttagaacgagggatggagggagcatcagccaggaacattgcaaaggaagcaggattgtcattaggtgcgctgcgccattatttctctacacaggatgaattgcttgcttttgcaatgaaacttgtccaagaaaaggtgactgaccgaattaaggacattgcagtgagggatttgctccctaaggaaaaagtgttgcaaattttgcttgaaatggtcccaacgaatgaagaaacgattagagagatggaggtttggtttgcttttactgcttacgccagacataaaaaggatatgtttgatgcgagtcatgacgggattttcagcggcatgcggaatttgattgcctatttagatgaatccgatttactgaagcagaatgctgataaagacattgaagctgagagactttacgcgcttgttgacggcttggctttacatgccatgcttgaccctgtgcgcgtgaataaagaccgaatcaagcgggtcattatgcagcatgtagagtcaatttgcgtggaagatacacgtgagacacaaaaacgacatccttaaggcactagtgcgaaaagcgattcttgttgggcatgcgtccaaaagagtcgcttttttattttcaaagaacaaggatctctgaaaaaaatggaaaacaatcatgctgtttggtaaagtggaatgaaagacggactgaggggtgaacactggtccatcgtttaagaactttacatgatagggatggtataaatgaatcttacttacaaggtgcatccaattaaaacaaggtatcagggctggacgaattattgctatatcattgaagatattgtaagcagatctgcaattgttgttgatccctcatgggaattgagtaagataaccactacactttctgaactcgaagcggaattaaaggcagtcgcattgacacactctcattatgatcatgtaaatctggtagacccgctgacgaagatgtttaacgctcaagtttatatgtcaaaaaaagaaattgattattatcaattccgatgcagaaatttaattagcctagatgatcatcagacaatcagcataggaaacacaagagcacaatgccttctcacaccggggcatacagccggcggaatgtgttatttgttttctgagagtatttttaccggagatacggtgtttacagaagggtgcggcatatgtgaggatgatggcagctctgcggaagagatgtttgatagcattcaaagaataaagtcggaggtttcaccccatgtacgggtgtatcctggtcactcatttggcaaatcgcccggccattcgataaaggatctttatcagcataatatttactttcaaattgataaaaaagaatattttgtgaaatttcgcactcgtaaaaaccaaaaaggtatttttgattttaaataatccttctgaatctattatcctatttttcttcgaatatctaaataatttttattttcgaaaatgattacatagaaggtgttatttattttgaaaactcatttgaaagaaaatgaagcgcattatcatgatatggcgccctatacgtgatccgggtcttttttcttatgttctgttatatctcctgatcctttattcctcaatggaaaaaagcagaaaaacaatggggcaaactgtaggaaaaattaacttgacggataatatttacagaggttaccatcaacatgaacatgctactatttatccggtcatcactattataaaatcatacagaagtgaaacacatctactaatcggaagggtggctttgagagaatgatcacatatgtttttccaggtcagggttcacaaaaacagggaatgggcagcgtcctattcgatgaatttaaagaactgacggatcaggcagatgagatcttaggatattctatcaaacgtctttgcctggaaaatccttattccaatttaaacaaaacgcaatttactcagccggcattatatgtggtaaacgcactaagctatctgaaaaaaatcaaggatgaagaagttaagcctgactttgtcgccgggcacagcttgggtgaatacaatgcgttatttgcagctgaagcctttgattttgagacaggtttacagcttgtcagaaaaagaggcgagctgatgagtctgataagcaacggcggtatggcagctgttatgggactaaatgaagagcaggttgcaaaggctctgaaaaaatatcatttacatgatgttgatatcgctaatgtgaatgccccatatcaaattgtaatttcaggaaaaaaagatgagattgaaaaagccgcatctctttttgaagcgatgactgaagttacaatggtactccccttaaacgtaagcggcgcgtttcattccagatacatgaataaggcaaaagaagaatttgaggagttccttcatgccttttatttttcgcctccgtctatcccggttatttctaatgtgtatgccaaaccgtatacatacgaattcatgaaacagacgctggctgatcaaattaatcattcagtgaaatggactgacagcataagctacttaatgaaaaaaggccatatggagtttgaggaggtagggcctggaaatgttttaactgggttaattcatcgcataaagaaagatgcggaagcaatgccccgctaaagcatttgcccctatggccatgtatctcatcaatcaggtctaaacacagatttcctttcatttaaggtataaagttttaaagattcaatcgttcgattgacactgtttctaattgaataactttatatactgttacataaagaggctcataaattaagttagacatttgaactatgtcagccggtctgtcaaaccatcgctcccacatctagatggtcctttttttaaccgcacccaccaatcatagagtcgatgttctttgctgatcctgttatcatgttacatcaattttgagatatcaacatacatctacgatcacgtcataaatgaaccgcatccagagcaccaatagcaatccttccaagttgaatctcctttactttttcacatatgtcttttccatttattaatttcatttcaatcgctgctatgtgctttaacaacatgcatggaaatgagaaatccaatagccgtcataaatataaaaaaagaaggttatacacatgaatgaaccgcttgtttttatgttttccgggcaaggttcccaatactatcacatggggaaagaactatttaaggaaaataccgtgtttcgccaatcaatgcttgaaatggatgccattgcagcacggcgaatcggcacatccattgttgaagaaatctaccatcaaggtaaacgtgtgtcagatccgtttgacagtattcttttttcccaccccgccatttttatgattgagtattccttatataaggttttggaagacaggggaatttatcctgattacgtattgggatcaagtctgggagaattcgcagcagcggcagtttctggtgtgtcagacgcagaggatatactggattgcatacttgaacaggctattatcatccagaattcctgcgataaaggaaaaatgctggccattcttgacaaaccgcaattgctgaatgatcatccgcaactgtttggaaatagtgaactcatttctatcaattatgattcgcacttcgtcatttctggtgaagaagatcatataaggaagattatggaggatttaaaggagaagcagattctttgccagctgcttcctgtgtcctatgcctttcattcttcgcttattgatccggcagagagtgcctatgcagaatttttaagatcaaaatcttttcaaaaaccgtcaataccgattgtatcgagcttaacgggaagctgccttcacgtaatggacgagaatttcttttggaatgcggtcagaaagccaatgatgtttcgtgaagcgattcgatatttggaaagccagcatacatgcaagtttatcgatttagggccatccggcaccttagctgcttttgtgaaacagctgattccgggtgattcagctgaccgttgctgctcaatcataacaccatttcatcaggagctgaaaaatctgaatacggttgagtatttccgtacaccagaaaggaagtttacaagatgattacatatgtctttccagggcaaggctcccagcaaaaggggatgggacaagggctatttgaacagtatcagcatttgacagatcaagcagatcaaatattgggctattcaatagagaagctatgtaccgaaaaatcatatctggatgtaaatcatactgaatacacgcagccggctttgtatgttgttaatgcactcagttacttgaagagagtggaggagaccggcagaaaacctgattttgcggcaggacacagcttaggagaatacaatgcgctgatggcagccggtgcatttgattttgaaaccggattaaggctcgtcaaaaaaagaggagaattgatgggacgaattacagggggcggaatggctgctgtgatcggcctgagtaaggaacaagttacagccgttttagaagagcaccgtctttatgacattgatgtggcaaatgaaaatacgccctggcaaattgtgatttctggcccgaaaaaagagattgaaaaagctcgggctgtttttgaaaacaccaaggatgtaaagctgtttcatccattaaatgtgagcggagcttttcattccagatatatgaatgaagccaaacaggtatttaagcaatatattgactcattccagtttgcacctttggcgatcccggttatctccaatgtctacgcagagccataccatcaagacagattaaaagatacattatctgaacaaatggacaacacagtgaaatggacggacagcattcgtttcctgatgggaagaggagaaatggagtttgcagagattgggcctggaactgttttaaccggtctcattcatcggattaaaaatgaagctgaaccattgacatatataccgaaaaagaaccccgcgatcagtgcgcatctaaaggagcaacgcaatgttcaagctgggattacggcagaatctttaggaagtgctgaatttaaacaagattatcatcttacatatgcttatcttgcaggaggaatgtaccgcggtattgcttcgaaagaaatggtagtaaagctgtcaagagcgggaatgatggggttctttggcacaggaggtctgagcctgaaagaggttgaagatgcgatccatgctatacaaggtgaattaggaaaaggacaagcctacggcatcaatctggtccacaatatgaaacatactgaatcagaagaaaaaatgatcgatcttttattgaggaatcaagtgagcattgtggaggcttcagcatttttaagtgtcactcctgcattagtaaggtaccgcgcaaaaggagtgaaacgaaatcaaaatggtgacgttatatgctcaaatcgtctcatagcaaaaatatcacggccggaagttgcagaatcatttctgagtcctgcgcctgagaatatgctgcaaaagcttttaggagaaaataaaatcactatgaacgaagctgagttgttgcggtgcattccgatggctgacgatatttgtgtagaagctgattcaggcggtcatacagatggcggtgtggcatacagcctgatgccggcgatgacatctttaagagatgaaatgatgaaaaaatatcaataccggaaaaaaataagagttggtgcagctggagggattggaacacctgaggcagcgatggcggcttttatgctaggggctgattttattctaacaggctcaatcaatcaatgtacggttgaggcggcaacaagtgataaagtaaaggatttgcttcagcagatgaatgtacaagatacagcctatgcgcctgcaggtgatatgtttgaatcgggcagtaaagtgcaggtgctaaagaaaggcgtgttctttcccgcacgggcaaacaagttatatgaactgtatcagcggtatgggtctatacgtgagctggatgcaaagatgctggcccagcttgaggagaaatactttaaacgcagtatagaagacatatataaagatattgcattgcattatcccgcggcagacattgagaaggctgaacaaaacccgaagcataaaatggctttgattttccgatggtacttcagatacagttcaaaattggcaatcagcggaagcgaacattcgaaggtcgattatcaaattcactgcggtcccgcgctgggagcctttaatcaatgggttaaagggtcgcaattagaaaattggcgaaaccgccacgtggatgaaatcgggaaaaaattaatgacagaaacggcagtattgcttcatgaacggatgcaatcgatgtatcagccgtcgcatgaaacagacaacataaaaataaaagtttgaatattatgaaaatatacctataaaaatcattaaaataatcccttgaaggagagagcgcattatggataaacagagaatctttgaagtactaatcaccaatatttgcgaggtgcttcctgaattagacggacacagatttgagcctgaagatcagttagttgagttaggagctgactctgtagacagagctgaaattatcacgatggtgctagaggatttatcgttaaaaatccctcgcattgagctatccggggtgaaaaacatcggtgaattagctgaggtgctttatgacaaagtgcaatctgcctgaggtggtggtgaccggtgtaggcgtcacggcctctatcggtcaagggaaagaggactttgcttcctcgctgctgtccggcagacatgcctttgatgtcatgaagcgttcaggcagacaaaaagacagccggtttatcggagccgaaattgcgtcattgtcttatcctgaccgactctccaaaaaaatgttgcgaaaagcatcattctccagccgcgctgcattggtaactctcacagaggcttgggaggaggctgaattggacgatgcagattcctcacgtatcggactggttgttggcggatcaaattttcagcagagagaaacctttgaagtttatgaaaggtatcaagaccgctccggttttatttcgccggcgtatggtctgtctttcatggatagcgatctttgcgggatatgtacagatcagtttggcatcacgggattagcatatacggtgggaggagcctcggccagcggccagttagcagtcattcatgcgattcagcaagtcctgtcaggcgaagttgatacttgcatagcacttggtgctttaatggatctttcttatatggaatgcgaggcgctaagggctttaggcgctatggggacggacaaatatgctgatgaacctgaaaaagcgtgccgtcccttcgatcaaaacagagacgggtttatctatggagaatcgtgcggtgcattggtaatagaacgaaaggagacggctttacgaagaggtctcaaaccttatgcagaattgtctggctggtcaatcaaactggacggaaaccggaatcctgatccttcattagaaggagaggttcatgtcatccagaaggcactggagcgtgccaggcttttaccagaagatattgattatattaatcctcatggaacaggctcttttattggagatgaaatagaattaaaggcgctccgtgcatgccggctttcccatgcttatatcaatgcaacaaaatcgataaccggacacgggcttagtgcggcgggcatcgtagagattatttctgttttgctgcaaatgaaaaaatctgccctgcatccgagcaggaatttggatcatccaatcgatgattcctttcattgggtaaatgagaaatcgatttcataccgcatcaaaaatgcgctgagcttaagcatggggtttggcggaatgaacaccgcggtttgtatacaaaacattgagaaatgtggaggcgaatcataaatggtttcagccggaatagaagcgatgaatgtctttggcggaacggcataccttgatgtcatggagctggccaaatacagacacttagatactgcgagatttgaaaacttattaatgaaagaaaaagcggtagcactgccttatgaagatcccgtgaccttcggagtcaatgcagctaagccgattattgatgctttatctgaagcagagaaggaccggattgaattgctgatcacttgctctgaatccgggatcgactttgggaaatcgttaagtacatatatccatgaatatttaggtctcaaccgcaactgccgtttgtttgaggttaaacaggcgtgttattcagggacagcgggatttcagatggcggtgaattttatattatcccagacttctccgggtgctaaagcactggttatcgccagtgatatttcacgttttttaatcgctgagggcggagacgctttaagcgaagattggtcttatgcggaaccgagcgccggagcgggagcggtggccgttttagttggcgaaaatcccgaggtgtttcaaatagatcccggagcaaatggttattacggctatgaagtgatggacacgtgccgccccattcccgacagtgaagcgggagattctgatctgtctttaatgtcatatttggattgctgcgaacagacctttctggaatatcaaaagcgtgtaccgggtgccaattatcaggacacgtttcaatatcttgcttaccatacgccctttggcgggatggtgaaaggtgcgcaccggacaatgatgcgtaaggtggcgaaggtgaaaacatccgggattgagacggattttttaactcgggtaaaaccaggtttaaactactgtcaacgggttggaaatattatgggggcagccttgtttctggcattggccagcacgatagaccaagggaggtttgattcgcctaaacgaattggctgtttttcctacggatccggctgctgttctgaattttacagcggaattacaactccgcaaggccaggagcgtcagcgaacatttggtattgagaagcatttggatcgccggtatcagctctccatggaagagtatgagctattgtttaaggggagcgggatggtgcggtttgggacgcgcaatgtaaagctggactttgagatgataccgggcatcatgcagtccactcaagagaagccgcgcttgtttttagaagaaatttctgagtttcatcggaagtacaggtggatctcgtgacctatcaaacgataaaggtccgctttcaagcgtcggtttgctatattacctttcaccgtcctgaagcgaataatacgattaatgacacgctgatagaagaatgcttgcaagtgttaaaccaatgtgaaacatcaacggtgacggttgtcgttttagaggggcttcccgaggtgttttgtttcggagctgattttcaagaaatctatcaggaaatgaaaaggggcagagaacaggcaagctcccaagagcctctctatgatttgtggctgaaattgcagaccggcccttatgtcacgatatctcatgtcaggggaaaagtgaatgccggcggtcttggatttgtatctgccacagatattgccattgctgatcagacggcgtcattcagtctctctgagctgctattcggcttgtaccctgcttgtgttttaccgtttctgatccgccgtatcggctggcagaaagcgcattatatgacgcttatgacaaagccgatttccgttcaggaagccagtgaatgggggttaatagatgcttttgatgctgaaagtgacgtgctgctgagaaagcatttattgcgtttgcggaggctgaataaaaaaggaatcgcacattataaacagtttatgagctcacttgatcatcaagtcaatcgtgcgaaagccaccgcgttaactgcaaatcaaaacatgttttctgatcctcaaaaccaaatgggaatcatcagatatgttgaaacagggcaattcccatgggaggatcagtaaccgtttaaaaatgacaatcagaaccgttaggaggacatcatgacgcattctgttgtagagcttatcgaaattgaatccgccattattcaggtaaagatgcaagatcgcactcataaaaacgcgttttcacaagaacttacagacggtttaattcaagcgtttgaatacatacggcagaacccaaaatacaaagcggtcattttgacaggatatgataattattttgcttcaggaggaacgcaagaaggactgcttcgaattcaacagggattgaccaagttcacagatgacaatctttattctctggcgctggattgtgagattccagttattgcggcaatgcagggccatggaattggaggcggctttgtcatggggctcttcgctgacatagtcattctgagcagagaaagcgtgtatacggctaattttatgaaatacggatttacgcctggaatgggcgctacctttatcgttcctaaaaaactgggtttcagcctgtcccaggaaatattattgaatgcgggcagctaccgcggagctgatcttgaaaaaagaggggttccttttaaggtgctgccccgtgcagaagtgttagattatgcagtggagctggcgcaagaactggcggaaaagccgagaaactcactggttacactgaaagatcatttggttgccccgcttcgcgatcagctgccgcgcgtcattgaacaggaattgatgatgcatgagaaaacatttcatcatgaagaagtcaaaagtagaatcaaaggtttatatggtaattaactgaaaatatatatataaattttgcaggtgaaatggaggcagcgtgatgagaaataatgataatatccgcatattagctaatccttctgtcagtcatggtgagcctttacatatatctgaaaagcagccggcaacaatacctgaagttttatacagaacggcggcagagcttggggatacaaagggaatcatttatttgcagccggatggaactgaagtttaccaatcatacagacgattatgggatgatggactgcgcattgcaaaagggcttcgccaatcaggcctgaaagcaaaacaaaacgtgattttgcagcttggtgacaattcacagcttctccctgcgttctgggggtgtgtgttaacaggggttgttccggctccattagccgttccgccaacgtatgctgaatcgagcagcggcactcaaaagctgaaagacgcatggacgcttcttgacaagccggcggtgattacggaccgggggatgcaccaggaaatgctcgattgggcaaaagaacaagggcttgaagggttcagggcaattattgtagaggatctgctcagcgctgaagcggacacagattggcatcaatccagtcctgaagacttagcgcttttattgctgacttcaggcagtacgggaacgcccaaagcagttatgcttaatcatcgtaacattatgagcatggtgaaagggattattcaaatgcaaggcttcaccagagaggatattacgtttaactggatgccgtttgaccatgtcggagggatcggaatgctgcatttgcgggatgtttatcttggctgtcaggaaattaacgtctcaagcgaaacaatcttaatggagccgttgaaatggctggattggattgatcattaccgagcttctgttacgtgggcgccgaattttgcgtttggtctggttactgattttgcagaagaaataaaagataggaaatgggatctgtcttcaatgcgatacatgctcaatggcggtgaagcaatggtagccaaggtagggcgcagaatacttgagcttttagaaccacatggactgcctgctgacgccatccgacctgcatggggaatgtccgaaacttcatcgggcgttattttttctcatgaatttacccgggctggaacaagtgatgatgatcattttgttgaaataggctctccaatccccggcttctctatgagaattgtgaatgaccgtaatgaattggttgaagagggcgagatcggccgttttcaagtctcgggtctttctgttactagcggttattaccagcggcctgatttgaatgagagtgtgtttacagaagacggctggtttgaaaccggagatcttggctttttgcgaaacgggcgcttaaccataacaggccgtacgaaagatgcaattatcattaacggcattaattattacagtcatgcaattgagtctgcagttgaagaattatctgaaattgaaacttcttatactgctgcttgcgctgtccgtctgggccagaattcaacagatcagctggctatcttctttgttacttccgcaaaattaaatgatgagcagatgtctcagcttcttagaaacatacaatcccatgtctcacaggtgatcggagtcaccccggaatatttgctgcctgtacaaaaagaagagattccaaaaacggctatcggaaagatccagcgcacccagctaaaaacttcatttgaaaatggagagttcgaccacttgctacataaacccaatcggatgaacgatgcagtccaggatgaggagatgcagcaagcagaccaggtgaaaagagtaagggaagaaatacagaagcatctgctcacctgtttgactgaggagctgcacgtttcccgcgattgggtggagccaaatgcaaatatccaaagtcttggtgtgaattctatcaagatgatgaagctcattcgatcgatcgagaaaaactaccatatcaaactaacagccagagagatacatcaatatcctacaattgaacgcttagccagctatctatcagaacatgaagacctcagcagcttgtctgctgacaaaaagggcacggacacatataaaaccgaaccggaaaggagtcaggcaacttttcagcctctctctgaggttcaaaaaggattatggacattgcaaaaaatgtcacccgaaaaaagtgcatatcacgtacccctctgttttaaattttcgtcagggcttcaccatgaaacattccagcaggctttcggccttgtattgaatcagcacccaatcttaaagcacgtcatccaagagaaagacggagtgccatttcttaaaaatgagccagcactttcaattgaaatcaagacagaaaatatctcaagtatgaaagagtctgatattcctgcttttcttagaaagaaagtaaaggaaccgtatgtaaaggaaaacagcccgttagtgcgtgtcatgagcttttccagatttgaacaagagcattttttattagttgtcattcaccatttgatttttgacggagtttcgtctgtcacatttatacgcagtctgtttgatacctatcagcttcttttaaaaggacagcagccggaaatagctgtttctcctgccatttatcatgattttgcggcatgggagaaaaacatgcttgccggcaaagacggtgtgaagcatcgtacatattggcagaaacagctatcgggaactttgccgaatcttcagctgcctaaggtcagcgcaagttcagtctctgagtttagagaggatacatacaccaggcggctgtccagcggcttcatgaatcaggtcagaatgtttgcgaaagagcattctgtaaatgtcacgacggtattcttaagctgctatatgctgctgcttggccgttacaccggccaaaaggaacagatcgtcggcatgccggccatggtgaggccggaagaaagatttgatgatgccattggacattttctcaatatgctcccgattcggagtgagctgaacccggcagacactttttctagctttatttcaaaattgcaattaacgatattggatggacttgatcatgcagcatatccttttccaaaaatggtgagggatctgaatattcctcgcagtcaagcaggttcaccggtatttcaaaccgcttttttctatcagaattttcttcaatccggaagctatcaaagcttgctgagccgctatgctgacttcttttctgtcgatttcgttgagtgtattcaccaagagggcgaatacgaattagtatttgaactgtgggaaacagaagaaaaaatggagctgaacatcaagtacaatactgggctgtttgatgcggcttctatatccgccatgttcgaccattttgtttatgtaacagagcaggcgatgttgaatccatctcagcctttaaaagagtattctttattacctgaggcagagaagcagatgattctcaaaacatggaacgccacaggaaaaacgtatccatatataacttttcatgagttgtttgagcagcaggcgaaaaagacgcctgatagaacggctgtcagctatgaaggtcaaacattgacgtatcgggagcttgatgagaaaagcacacagctggccatttatttgcaggcgcatggagtgggtcctgaccgtctggcgggaatctatgtggatcgatcgctggatatgctagtgggtttattagcgatcctcaaggctgggggagcgtatgtgccgctagacccgtcctatccggctgaacgattagaatacatgcttgaggacagtgaagttttcattacactgacgacatcggaattagtaaatacgttgagttggaacggtgtcacaacagctcttttagatcaagattgggatgaaattgctcaaacagcctctgatcgaaaagtgcttacacgcactgtcacgccggagaacttggcatatgtcatttatacatccggcagcacaggaaagccaaaaggtgtcatgatactgcataaagctttgacaaactttctcgtttcgatgggggaaacaccaggtcttactgcagaggataaaatgcttgctgtcacaacctattgttttgatatcgcagttctggaattatttttgcctttaataaagggcgcacactgctatatttgtcaaacggagcatacaaaagacgttgaaaaactgaaacgggacatccgcacgatcaaaccgacagtgatgcaggcaacccccgctacgtggaagatgctcttttattcaggctgggaaaatgaagagagcgtgaaaattttatgcggaggcgaagcattgcctgagacattaaaacgatatttcttagatacgggcagcgaagcctggaatatgttcgggccaaccgaaacaactatctggtcagcggttcagcgcattaacgatgaatgctctcatgccacgataggaaggccaatcgccaatacacaaatctatattacggattctcagctcgcgccagtgccggcaggtgtcccgggtgagctgtgcattgcaggagacggtgtggcgaagggctactacaaaaaggaagaattaacggactcgagattcattgacaacccttttgagcctgggtctaagctttatagaacgggagacatggcccgctggcttccgggagggcgaattgaatatataggccgcatcgataatcaagtaaaaatccgcggattccgtattgaacttggtgatattgaaagcaggcttagtgagcatcccggcattctggaatgcgttgtggtcgcagatatggataacctggctgcctattatacagctaaacatgcaaatgcttctctcacagcgagagagctgcgtcattttgtgaaaaacgctttgcctgcctttatggtgccttcttattttattcagcttgatcatatgccgttaactccgaacggaaagatagatagaaacagccttaagaatatcgatttatcaggggagcagctaaagcaaaggcagacctctcctaagaacattcaggatactgtttttaccatttggcaggaagtgctgaaaacgagtgacattgaatgggatgacggatttttcgatgtgggcggggattcgcttctcgcggtcactgtggctgatcgtatcaaacatgaactatcctgtgagttttctgtcacagacctgtttgagtattcaacgattaaaaatatcagccagtacatcactgaacagcgaatgggcgatgcaagtgaccatatgccgacagacccggcagctcatatagaagatcagtctaccgagatgagtgatctcccagactattatgacgatagtgtagcgattattggcatatcgtgtgaatttccaggggcaaaaaatcatgatgaattttgggagaacctcagagacggcaaggaaagcatagcgtttttcaataaagaagagcttcagcgctttggcatttcaaaggagatagcggagaatgccgactatgtccctgctaaagcttcaattgaggggaaagacagatttgatccaagcttctttcaaatctctcctaaagacgctgaatttatggaccctcagcttcggatgctgctgactcattcatggaaagcaatagaagatgccggttatgctgcgagacagattccgcaaaccagtgtttttatgtcggcaagcaataattcttatcgcgcgctgctgccgtcagatacaacagagagcctggagacgccggacggctatgtttcgtgggtgcttgcacagagcgggacgatcccgacaatgatttctcataagctcgggctgagagggccaagctatttcgttcatgccaactgctcatcatctctgattggattgcattctgcctataaaagcctcctgtcgggtgaatctgattatgctttagttggcggtgcaacgctgcataccgagtcaaatatcggatatgtgcatcagccggggctgaacttttcgagtgatggacatattaaagcttttgacgcttcagctgacggaatgataggcggtgagggcgttgctgttatattgctgaaaaaagcagctgatgcagtaaaggacggggatcatatctatgccttgctgagaggcattggtgtaaataacgacggcgctgacaaagtcggcttttatgctccaagcgttaaaggccaggctgacgtggtccaacaggtcatgaatcaaacgaaggtacagcctgaatccatctgctatgtagaagcacacgggaccggaacgaagctgggggacccgatcgagctggcggctttaacaaacgtttacaggcaatatacaaataaaacgcaattttgcggcattgggtcggtgaaaaccaatatcggacatttagatacagccgccggtcttgcgggctgcattaaggttgtgatgagtctttatcatcaagagcttgcaccgagtatcaattataaggagccgaatccaaatacagacttagccagctctcctttttacgtcgtcgatcaaaagaaaacgttaagccgtgagatcaaaacgcacagggctgcacttagctcgttcgggcttggcgggacaaatacccatgccatttttgaacaattcaaaagggattcagataagggaaagatagacggaacctgcatcgtcccgatctcggcgaaaaataaagagaggctgcaagagtatgcagaagacattctggcctatttagaaagaagagggcttgagaacagccagctgcctgattttgcgtatacccttcaggtggggcgcgaagcgatggagcatcgcgttgtctttattgccgatcatgtaaatgagttaaaacagaggctcacagattttatcaatggaaatacagcgattgaaggctgttttcaaggaagtaagcacaatgccagagaggtttcatggctgacggaggatgaggacagcgctgaactcatacgtaagtggatggccaaaggaaaagtaaacaagcttgcagaaatgtggagcaagggagcgcatatagattggatgcagctttacaagggagagcgcccaaacagaatgagtctgccgacttatccatttgcaaaggaacgatactggccgtcgcaggatgaccgcaaaccggtggcgcagatatccggaaatcagacagggatcggctctattcatccattgcttcatcagaatacatctgatttttctgaacagaaattcagttcggttttcactggtgacgaatttttcctgagagaccatgtggtaagaggaaagcctgtgcttcctggtgttgcgtaccttgaaatggcgtacgcggctataaaccaggcggcaggaagtgaaattggccaagatgtcagaatcagattgaatcatacagtctgggttcagcctgttgtggttgacagacattcagctcaagtggatatcagtctctttcctgaagaagatggaaaaatcacctttgacatttacagtacacaggaagacggggacgaccctgttattcatagtcaaggcagtgcggagctggcatctgccgccgaaacgccagtcgcagatctcactgaaatttcacgccgctgcggcaaaggaaagatgtcgcctgatcaattttacgaagaaggcagaagcagaggaatgttccatggtccggcctttcaaggaattaagaatgtgaatataggaaacagagaggttttggcgcagctgcagcttccagaaatcgtttctggaacgaatgaacagtttgtgctgcacccaagtatcatggattccgccttgcagacagcaacaatatgtatcatgcaggaattgacggatcaaaagctgattttgccatttgcgcttgaggagcttgaggtgatcaaagggtgttcttcttctatgtgggcttatgcccgcttaagtgacagcgatcactccggaggggttgttcagaaagcggatatcgatgtcattgacgagagtggaagcgtatgtgtcaggatcaaaggattctcaacgagagtattagaaggggaggttcatacttcaaagccttcaacacggcacgaacgcttaatgcttgaaccggtgtgggaaaaacagaatgaagaacgagaggacgaagatccttcgtacacggagcatatcattgttctcttcgaaactgaacgaagtgtcacagacagcattgcctcccacatgaaagatgcccgtgtgattactctaaacgaagctgtaggacatattgctgaacgttatcaatgttacatgcagaacatttttgaactcctgcaaagcaaggtccataagctttctgcaggccgtatcatcattcaagcgattgttccgctggaaaaagagaagcaattgtttgccggcgtttccggtctgtttaaaacagcagaaatagagttcagcaaactgactgctcaggtcatcgaaattgagaaacctgaagagatgatagaccttcacctcaagctgaaagacgacagccggagaccatttgacaaacagattcgatatgaggctggacaccgttttgtgaaaggctggagggaaatggtgcttccttcagctgatacgcttcacatgccgtggagagacgaaggcgtttatctaatcacaggcggagcaggaagcttaggccttctgtttgcaaaggaaattgccaatcgaactggccggtctactattgtgctgacgggacgatctgttttaagtgaggataaggaaaacgaactggaggctcttcgaagcatcggagcggaggttgtctatcgagaggctgatgtaagtgatcagcatgcggttcatcatctttttgaggaaatcaaagaaagatatggcactctcaatggaattattcacggtgcaggcagcattaaagatcacttcatcattcataaaacgaatgaagagtttcaagaagtattgcagccaaaagtgagcgggttgttacatgtagacgaatgcagcaaggatttcccattggactttttcattttcttctcatctgtttcgggatgtttaggaaacgctggacaagccgattatgcggcagccaattcgtttatggatgcatttgctgaataccgccgttctcttgcggcatcaaaaaagagattcggctccaccatttccttcaattggccgttatgggaagaaggcggtatgcaagtcggcgctgaagatgaaaagagaatgctgaaaacgacgggaatggtcccgatgccgacagatagtggcttgaaagcattttatcaagggatagcatctgataagccgcaagtttttgtgatggaaggacagcttcagaaaatgaaacaaaaactgctttccgcaggatcgaaagccaagcggaacgatcagagaaagacggatcaggatcaaggacaaactagaaaattggaagcagccttaatccaaatggttggcgcaattttgaaagtaaacactgacgatatcgatgtcaacacagagctgagtgagtacggattcgactcagttacattcactgtctttacaaacaagatcaacgaaaaatttcagttggagctaacaccgaccattttctttgaatatggcagcgtccaaagcctggccgaatatgtagttgctgcgtatcagggcgaatggaatcaagatgctactgctaaaggcatagatgaaagaacaaactcattgcacagtttaaacagcctggaggcatcattaagcaacatggtcagtgcaattttaaaagtaaatagtgaagatattgatgtcaatacagagctgagtgaatacggatttgattccgttacatttacggtctttacaaacaagattaacgaagaatttcagttggagctaacgccgaccattttctttgaatatggaagtatccaaagcctggctgagtatttgactgctgaacatgaggacaccctggttcaggagcgcgaaaaaccagaggggcaggaagagttacagacaaaatcccctgaagcgccgaaaatcacatcacgtagaaagcgccgctttacacagcctgttattgcaaaagcagaaagaaacaaaaagcaggctgccgattttgagccggttgcaattgtcggcatcagcggccgattccctggcgctatggatatagatgaattttggaaaaacctagaaggagggaaagacagcatcacagaagttccaaaagatcgatggaattggcgggagcattatggaaacccagacactgacgtcaataaaactgacatcaaatggggcgggtttattgatggtgtcgcagagtttgatccgttgttttttggtatttcgccgcgagaagctgattatgtagaccctcagcagcgcttgttaatgacatacgtgtggaaggcactggaagatgcgggttgctcgccgcaaagcctttcgggtacagggaccggtatctttatcggtacgggaaacaccggttataaagatctattccatagagcgaatcttccaattgaaggccatgctgctacaggtcatatgattccttcggtaggcccgaatagaatgagttattttttaaatattcatggtccgagcgaaccagtagagacggcctgttccagttctcttgtagccattcaccgtgctgtgactgcgatgcaaaacggtgattgtgagatggcgatcgctggaggcgtgaatacgatcttaaccgaggaggcgcatattagctacagcaaggcgggtatgctcagcaaagacggcaggtgtaaaaccttctccgccgatgcgaatggctatgccagaggcgaaggggtcggaatggtcatgttgaaaaagctggaagatgccgagcgcgacggaaatcatatttatggcgttattcggggcacggcggaaaatcacggcggaagagccaataccctgacatcgcctaatccgaaagcacaagctgatttgttggtgcgtgcatatcgccaagcaggcatagatccaagcactgtcacatatatcgaagcacatggaacagggacggaattgggcgatccgattgaaataaatgggctgaaagccgcgtttaaggaactatccaatatgagaggcgagagccagccggttgttccggatcaccgttgcggcatcggctcagttaaaagcaatatcggtcatttagagctagcagccggtatttccggtttgatcaaagtgcttttgcaaatgaagcataaaacgttagtgaaaagcctgcattgcgagacgcttaatccttatcttcagctgactgacagtccgttttacatcgttcaggaaaaacaggaatggaagtctgtcacagatcgtgacggaaacgagcttccgcgccgtgccggaatcagttcgtttgggattggcggagtgaacgcgcatattgtggttgaagaatatatgccaaaagccaattcagaacacacggctacaggacagccaaacgtgattgtgctgtcggctaaaaataaaagcaggctgatagatcgtgctttgcaattgcttgaggcgattcgcaataaaaaatatacagatcaggagttgcaccgcatcgcttacaccctgcaggtcgggcgcgaagaaatggatgagcgtctggcgtgtgttgcggggacaatgcaggaacttgaagagaaactgcaggcgtttgttgacggtaaggaagaaacagacgaatttttccggggacagtctcatcgaaataaagagacccagactatttttacagcagatgaagatatggcgttggcacttgatgcttggatcagaaaaagaaaatacgccaaacttgctgatttatgggtcaaaggggtctcaatccagtggaacacattatacggagagaccaaaccgcgcctgatcagcctcccttcatatccgtttgcgaaggatcactattgggtgccggcaaaggaacgttcagaaagagacaaaaaagaactggttaatgcgattgaagatcgggctgcatgctttttgacgaaacaatggagtttgagtccaattggctcagcagtgccggggacaagaaccgttgccatcctgtgcaatcaagagacagcagatttagcagcagaattgtcttcgtattttccgaatcatctcttattagatgtgagccggatagaaaatgatcagtcagacattgattggaaagagtttgacggcctagtggatgtcatcggatgcggtagggatgatgagggccggctggattggattgaatgggtgcaaagactggttgaattcgggcataaagaggggctcaggctgctttgtgtgacgaaggggctcgaatcgtttcaaaacacatctgtccggatggctggcgcctcacgggctgggttgtatcgaatgctccaatgcgagtacagccatcttatatcaaggcatatggatgctgaggaggttactgatcatcgccgtctcgcgaagttgatcgctgatgagttttattccgattctcatgatgccgaggtttgctacagagatggtttacggtaccaagcttttctaaaagctcatccggaaacaggtaaggccacggaacaaagcacggtcttcccgaaagatcatgtacttctcattacaggcggcacacgaggcatcggactattatgcgcccgtcattttgcagagtgctatggagtgaaaaaactggtgctgaccggacgagaacagcttcctccgcgagaggagtgggcgcgttttaagacatcaaacacatcattggcagagaaaatccaggcagtgcgggagctggaagcgaagggtgtacaggtggagatgctgtcgctgacgttatctgatgatgctcaggttgagcaaacgctgcaacatatcaagcgaacattaggaccgattggcggtgtcattcattgtgcaggtctgacggatatggatacgctggcatttatccgaaaaacttcagatgatatccagcgggtgatggaacctaaggtgtcaggtcttacaacgttatatcgccatgtgtgtaacgagcctttacagttttttgtcttattttcttctgtttcagccattattccggagctttcggcgggacaagctgactatgcgatggccaatagctatatggattattttgcagaagcacatcagaaacatgcgccgatcatcagtgttcagtggccgaactggaaagaaaccggtatgggtgaagtgacaaatcaagcgtatcgggaaagcggcttgttgagcattacgaattcagaaggcttacgttttctagatcaaattgtatcgaaaatgttcggaccggttgttctccctgcgatggcgaatcaaacaaactgggagccggaactgctgatgaagaggaggaaaccgcatgagggcggtttgcaggaagctgctttacagagcccgccagccagagacattgaagaggccgatgaagtttccaaatgtgatgggttattatctgaaacacagtcctggctagttgatctgtttaccgaagagctgagaatagatcgtgaagacttcgagattgacggggtgtttcaggattatggcgtggattcgatcattttggcacaagtgctccagcgtataaaccgcaaattagaagcagcactcgatccatcgattctatatgaatacccgacaattcaaaggttcgcagattggctgatcggttcttattccgaaaggctgtccgctttattcggaggcaggatatcggatgcatcagcacctttggagaacaaaatagaggcggaggcatctgttcctgcggaggatcgagctcttacacctcagattcaggcgccagtgattttgtcaccggactctcatgcagaaggtattgccgttgtcggactctcttgccgattccctggggcagatacattggagtcatattggtcgttactatccgaggggcgttcgtcaatcggcccgattccggcagagcgttggggctgtaagacgccatattatgccggcacgattgatggcgtcagctattttgatcctgatttctttttgcttcacgaagaagacgtaagggcgatggatccgcaagcactgctcgtgttggaagagtgtctgaaactcttgtatcacgccggttatacacctgaggaaataaagggcaagcccgtcggtgtttatatcggaggcagaagccagcacaaacctgatgaagagagccttgatcatgccaagaatccgatcgtgacagtcggtcaaaattatttagcggctaatctttcacaattttttgatgtccgcggcccgagtgttgtagttgacaccgcatgctcgtcagctttggtcggcatgaatatggccattcaggcgctgcgtggcggagatattcaatccgccatagtcggcggtgtcagcttactgagctcagatgcctctcacaggctgtttgaccggcgcggcattttaagcaagcattcatgcttccatgtgtttgatgagcgtgctgatggagttgtgttaggtgaaggcgtcggaatggtcatgttaaaaacggtaaaacaggcactggaagacggagataccatatatgctgttgtgaaagcggcctcggtcaataatgacggaagaacggcggggcctgcaacacctaatctggaggcgcaaaaggaagtcatgaaagatgcgctttccaaaagcggaaaaaaaccagaggacatcagctatcttgaggcaaacgggtcaggttcaatcgtaaccgatctccttgagctaaaagcgatccaatcagtgtaccgttctgggcactcatcgcctctttctcttggctcaatcaagccgaacatcgggcatccgctatgtgctgaagggatcgccagcttcattaaggttgtgcttatgctgaaagagcgccgctttgtcccatttttatcaggtgaaaaagagatggcgcatttcgatcaacagaaagcgaacatcacgttcagccgagccctggaaaaatggacagattcgcagcctactgcggctattaactgctttgccgatggggggacgaatgcccatgtcatcgtagaggcgtgggaaaaagatgaaaaacacgccatcaagcgcagtccaatatcgcctcctcaattaaagaaacgaatgctttcgccaggcgagacaaagctggaagcggagacttcgaaaatgactgcggcaaacatatgggatacttatgaggtggaggtctaacgtgaaaaagataacgaaacaactcacattatcgttaaaaaatccgtttatttatcaccatgtggtttacggacaaaatgtcctgccgggattggcttatatcgatataatctaccagatattcagagaacacggcttctcctgctcagagcttcagctgcggaatttatctatctatcagccattgacgacggaacaggatgcagtaattgttctgaatatccaatgcgcggagaaaaaagaaggaaagtggcaaatcacagccaagggaattgaaaaacgtgacgggaaagaagcttcggaagaaaagctctatatgaaggctgacatgcacgcagactccccagccatatttgaagaaacactggatttcagtcaaatcaaagcatctgcacagaacgttgttcagcttgatgatgtatatgaacaatgcagacgtcaggaattggtgcacagcgaatatatgaaagcaaaaggctgcatctatgaagaggaagacggcgttcttcttgagctttctctcggttcggaagccatgcttcacgcagaaggctttatgtttcacccgactctcatagacgggagcggggtgggtgccaatcatttgctcacatctttgcttaaaggagaacagaggctgtatttgcctctgttctatgaatccttttccgcttctgcacttttgcagtcggattgcatgacaagaattaagcgctcctccgtccggcgggaaaaagagctgatttatgtaacacttgaattttttaatgcgtcgggagaaaaagtggctgagttgaaaaactttacaagcaaattggtgcgagaagcggagctgattagcggaaaacatcaagatgcacaggagacacagatgacaagagcggacactgttgagcgtgataaacctgctgacatggtttcttctcccgttgattcctacagcggggctgaacagttcgtaagccaattaattgcagagaaaatcaataagccggtagaacaagttgaaaaacaggtcggttattaccaaatgggactgaattcatcgggcttgcttgaggtggtagaaacgatcagtgataagatcggtgagagcctttcgccgactcttctgtttgagcataccaccatagcggagctgtcagcgtttcttgccgaggaatatgctgagcattttagtgccgctggttcccttggccttggccagaatgaaagagcacgcgtttccgacacaataaacgatcgtaagactgttgaagcttctcgtcctgcacctgttgaggcagcaggcgatattgcgattatcggcttggcgggcaggtatccgaaggcagccaatattcatgaattttggaacaatctgaaagaggggaaggactgcgttagcgagattcctgagtcgcgctgggattggcagcgacttgaaggaatcacatctccttcgggtaaggacatttcgaaatggggaggatttattgatgatcccgactgcttcgatccccaatttttcagaatcacgccaagagaagcggagacaatggaccctcaagagcggctgtttttagaaacatgctgggaaacgattgaggatgcgggctatacgccaaagacgttggccaagcctaaaggacgaaataaaaggcagcatgtaggagtttttgccggtgtcatgcacaaggattatacattagtcggagctgaagaagcatcagcagaaaacgtgtttcctctctcgctcaactatgcgcaaatcgccaaccgtgtttcttacttttgtaatttccacggtccgagtatggctgtcgatacggtatgttcatcctctttgaccgcagtgcacttggcgttggaaagcatacgtcacggtgagtgcgatgttgcgttagcaggcggagtgaacctgtctttgcacccgaataaatatatgacatacggggtctgggatatgttttccactgacgggcactgccgtacgtttggaaaggatggggacggttatgtgcctgccgagggtataggcgcggttttattaaagcctttgcgccaggcggagaaagacggagatcgcatttatgcagttattaaaggaagtgctgtgaatcatgtgggcactgtaagcggcatttcagtgccgagccctgtttctcaagctgatctgattgagacatgcttggagaaaacgggaatcgacccgcggacgatcagttatgtggaagcccatggaaccggcacgtccttaggagatccgatcgaaatacagggattagtgaaagcgttccgccaatatacgcaggatcggcagttctgttcaatcggttctgtaaagtcaaacattgggcacgccgaatccgccgcggggatcagcggtttaagcaaggttgcccttcagcttcaccatcaaaaacttgtgccttctttgcattcggaagaactgaatccgtacgttgattttgaaaagtctccattttatgtacagcatgaaacagaaacgtggaagcagcctgttatcaaggagaatggggaagaggtcccttatccgcggcgggcgggtatcagttccttcggagcaactggttcaaacgcacatattatccttgaggaatatattcctcaaacagcggagcaggacgtttctttgtcctcagattctgacatatccgcagttattccgctttctgcccgtaatcaagaacgtcttcgtgtatatgcaaaacgtctcttggattttcttcatgatgggattcagattagagatttggcgtatacattgcaggtaggccgtgaaccgatggaagaacgggtttctttcttagcatccggaattcaagaattgagcgaccaattgaaggcttttatagaaggacgaaaaaccattcagcattgctggaagggccgcgtgtcaagaggaagcgaaccatcgcgtcccggcgaatcggtacataaattgctggagcaaagaaaactcgatcaaattgcggagcagtgggcgaacggatctggtgttgactggaagctgctttacgagggaaacaaaccaaagcggatcagcctgccgacttacccatttgagagggtgcgttattgggtgccgaaagcggagaaaaagactgatcgtttaaaggaggagcgacacatcctgcatcctcttctgcatcaaaatgtgtccgacatatcgggtgtccgcttccgttcagcgtttacaggacgtgaatttttcttgaaggatcatgtcataaagggcgaacacgttttacctggcgcagctttattggagatggttcgggcagctgtggaaagggcagctgcggatcagttcccgacaggattccggctccggaatatcgtctgggtccggccgttcgccgtcacagaacagcagaaagatatagatgtacgtctatatcctgaggacaatggtgagattacatttgaaatctgccgggaccctgaaagcgcagaggagtcgccgattgtatatgggcaagggagtgcagtgctttgtgaggctggtgaaaatccggtcatcaacattgaagaactgaaggcaagctataatggccggacgctgtcaccttttgattgctacgaggcttatacagaaatgggtattcattatggtgacagccacagagcgatcgacagcctatatgccggcgaaaacggagttctagtgaaattgacgatgcctcctgtaatctctgatacagaagaccattatattctgcatccgagcatgatagattcggcatttcaagcatctatcggtttgaggctgggaggagctacgagtttagaagacagaaaggcaatgctgccttttgccatacaggatgtccaaatcttcaaaggctgcgaggcatctatgtgggcgcggatcacatatagcgagggcagtacagctggggatcgtatgcagaagcttgatatcgatttatgcaatgaagaggggcaggtttgcgtgcgattgacgggctattctgcaagagtgttagaaatagatcaagaaggtccttctgaagcgactgacacgctattgttcgaacatatttgggaagaacgtgctacagagaggcaagagctcatagagtacgacacacataaagtcgttgtctgtgatgttggagaacaaatggaaagcctccaaaatcatcttgactgtacagttctgcagcatgatacagagacaattgatgaacggtttgaaggttatgccatacagttatttgaagaaatcaaacagctaatgcactcaaaaacagggggacatacattcattcaagtggcggtgcctgcgttggacgagcctcagctattaagcggcttaactggattgctcaaaacggctgaactggaaaatccaaaactgacaggacagttgatcgaaatagaaaccgggatgtcagctggtgacctattcgaaatattggaggaaaacagacgctatccgcgtgacacgcatatccggcactggcaagggaagcgatttgtaagcaagtggaaagaagtgtctggtgagcacctaagtgctgacatgccatggaaggataaaggcgtgtatctgatcacaggcggtgcgggcggtcttggattcatctttgcaactgaaattgcaaaccaaacgaatgatgcggttgtgatcctgacaggacgctctccgcttgatgaaaggaagaagaagaagcttaaagccttacagaaacttggcatccaagcgatttacagacaagctgatctggctgacaaacaaacggttgatgccttattaaaagaaacccaaaacgtttatggagacttagatggcatcattcacagcgccggtttaataaaagataatttcattatgaagaaaaagaaagaagaggttcaaaccgttcttgctccaaaggtagcaggactgattcaccttgacgaagcaacgaaagatattccgctcgatttctttatccttttttcctcaggtgccggagcagtaggaagcgcgggacaggctgattacgcaatggccaatgcatttatgaatgcattcagcgaatatcgcaatggccaagcagagctgcacaagcgttacggaaaaactctttcagtgtgctggccgctgtggaaagacgggggcatgcaaattgatgcggaaactgcaaggatgctgaaaagagaaacaggcatggtggccatggaaacagatcgtgggattcaggcgctatatcatggctggacgtcaggaaagccgcaagtgttagttgcttccggtgttactgatcggattcgtgcatttttacatgaaacgggacatggcaaaggccaatctcacgatatcaaaaaaagcagtctcaatcaggaggcagaaaaagcagacatgatcggggaaattgatgaagaaatactaagagaaaaagcggagaactattttaaacaggtgctttcttcggtgattaagctgccagccggccagattgatgctgaagctcctctcgaggattacgggatcgattctatcatgatcatgcatgtaacgggtcaattagaaaaagtattcggttctttgtccaagacgttgttctttgaatatcaggatattcgctcattaacacggtattttattggttcccgcagagaaaaactgctggacatcttgggaattgaaacaggaaaaccttctgttgaaagaaaatcagaacctgaaaaacaagaaatcccagttaccctaagaaagtctggatttcttcctttgcgagataaagagcagaagcagttaagagagaaggaaacggaagaaatcgcgatcatcggtatctcaggtcgctatccacaggcagacaacattgatgaattgtgggaaaacctgagagacggtcgagactgtattactgaaattcctgcagaccgctgggatcacagtctttattatgatgaagataaagacaagcctggaaaaacctacagcaagtggggaggcttcttgaaggatgtagacaagtttgatcctcagtttttccatatatcgccgcgtgaggcaaaatttatggacccgcaagagcgtttatttttgcagtgcgtgtatgaaacgatggaagacgcaggctatacaagagagcacctcggccgtaagcgtgatgctgagcttggcggaagcgtcggtgtttacgtcggtgtcatgtacgaagaatatcagctgtacggggcacaagagcaggtgcggggaaggtctctggctttaacgggaaatccatcatccatcgcgaaccgggtatcttattattttgattttcacggaccgagtattgctttagacaccatgtgttcttcttctttaacggctatccacttggcctgccaaagcctgcagcgcggagagtgtgaggcggcattcgcgggcggcgtgaatgtgtcaatccatccaaataaatatttgatgctcgggcagaacaaatttatgtccagcaaaggccgatgtgaaagcttcggacagggcggagacggctatgtgccgggggaaggcgttggagcagtgcttttgaagccattgtctaaagcagttgaagatggtgatcacatttatggaatcattaaggggacagccatcaaccacgggggaaaaacaaacgggtactcagtgcccaatccgaatgcccaagcagatgtcatcaaaaaggcgtttgtggaagcgaaggttgatccgcggacagtcagttacatcgaagcccacggcacgggaacctctctcggtgatcctattgaaatcacagggctgtccaaagtgtttacgcaagaaaccgatgacaaacaattttgtgcaatagggtcagccaaatcaaatatcgggcactgtgagagtgcggcaggtatcgcaggagtaacgaaggtattgctccaaatgaaatacaggcagcttgcgccttccctgcattcaaacgtgctgaacccgaatattgatttccttaactcgccgtttaaagtacagcaagagctagaagagtggaagaggccgatcatcagtgtcaatggcaaagacatcgaattaccgagaatcgcaggagtctcttcatttggtgccggaggtgtgaacgcccatattttaatagaagagtatgctccggaacctgtggaggaacgtttaccagcgaggaaacagccggctgtcattgtgctctcagcaaaaaatgaggaaagacttcagaaacgcgcggagcgattgctgcatgccattcgtgaacaaacatatgttgaagcagatttacaccgaattgcctatacgctgcaagtcggccgggaagcgatgaacgaacggctggcgttcgttgcggaaacgatgcaggagcttgaagaaaagctgtatgaatgtatctccggaacagaaaatcgtgaatatgtctatcgcggacaagtaaagagcaacaaagaagccattgctgcttttgctgctgatgaggatatgtcaaaaacaattgaggcatggctgcaaaaaggaaaatatgcgaaggttttagacctgtgggtaagaggtttgcgaatcgactggagcacgctatatcaggatcaaaaaccgcggcgcatcagtttacctgcctatcctttctcaagagatcgctattggatagacgtacatgcaaaggctgaggtaaaaagaacggaggagccattcgctccagtacagcccgttattccaaagccgtctgtagacagagaagccagcggcaagcctgccaatattacgttacagcctttaatgaccaatcaggatcgtttggagcggacagcatctctggttccatcagatacagaaacagagacgatcacggcggagaccttgtgcgatgaactgacagcgagcttagcggaagtgctgtacatggaccaaaacgagattgatccagacgaagcattcatagatatcggtatggactcgattaccgggctcgaatggataaaagcaataaataaacagtatggcacatcactaaatgtcacaaaggtatatgattatccgaccacacgtgatttcgctgtttacttagcacacgagttaagcacacaagctggggagaaaaaacaaacggagacgtacacgccgatcagacaaaaaacagcggtacctgctgctaaaccggctaatatatctctgcagccgttagaacatcatcagccagtgcaagaggaagctgaagaaacgattcaatatgcagcggcagaaatatctgcatcaagacaatatgctgtagcaattgaaacgctgcatgaaaacttgagggaaagcatagcagacgtgttatacatggagccatacgaggtggatattgacgaagcgttcatagatatcggaatggactcgattaccggactcgaatggataaaagcggtgaacaagcaatacggaacgtcttttacggtaaccagggtatatgattatccaacgatacgtgattttgctgaaatgctaaagtccgagcttggaactcatcttgatagaaagatagagcatactgactctttcgaagcagcccagcaaaagccagcagcaccatctcatccaaagctggcagaacggccccttcagcctgttcaacatccaataaagaaagaacatgagaagaaaacggttcctgttcatcaagaccgcccggaggatgcgatagcgattgtcgggatgtcgggaagatatccgggcgctcgtaatgtaagagggtactgggataacctggttcatgcgagaaatgccattcgggacattccaacatcacggtgggatgttgacaaatactatgatcctgtcctcaacaaaaaagggaaagtctattgcaaatcaatggggatgcttgatgatattgaacattttgatccgttgttttttaatattccgccgtcagaagctgaactgatggacccgcagcatcgaatctttttgcaggaaggctataaagcctttgaggacgctgggtacaacgcccgaactttaaatgagaaaaaatgcggtgtatatctcggcattatgagcaatgaatacggggtcatgctgaaccggcaggcaagagcaaatgccaccgggaacagctttgcgatcgctgcggcgcgtattccatattttcttaatttaaaagggcctgcgattcctattgacaccgcttgttcatcttcattggtcggcacacatttagcgcggcaggcacttataaacaaagaaattgatatggcgctggtcggcggggtcagcttatacctgacgccggaatcttacatcagtatgtgtgaggccggcatgctttcacctgatggacaatgtaaagcatttgacaatggcgcgaatggttttgtgcccggcgagggtgcgggtgcgctggttctgaaaaggctgaaagatgcggaagcggaccgtgaccatatttatggcatcatcattggctcgggtattaatcaggacgggaaaacaaacggaatcacggcaccgagtgcgaaaagccaaatggatctggaaagagacatatatgaaacatacggcatacatcctgagagtatcagttatgtcgagatgcacggcacaggaacaaaacaaggcgatccaattgaattagaagctctgtccaccgtatttcaagaaaaaacagacaaaaagcagttttgtgcaatcggttccgtcaaaagcaatattggccatacatccgcggcggcaggagtagccggggttcaaaaagtgttattgtgcatgaatcataaaacacttgtgccgacattgaacttcacgacaccgaatgagcattttgaatttgagcattctcctttatacgtaaatacggagcttaagccttgggaaacgactgatggaaaaccgcggagagcatgtgtgagctctttcggatatagcggaacgaatgcccatattgtgatagaggaatatcagcctgacaagaggaacgatcgattaacaaagcagcaccgctcagcattatttgcactctcagcgaaaaaagagaagcaattgaaggcctatgcggaagcaatgaaagatttcgtaacttccaatgaagatatcgatctggaggatatggcatacacacttcagacgggccgggaagcaatggattatcggcttgcgtttttgacggattcgagagaaatgctgatcaaaactttagatgattatttggctgagaagccgaacagcagcatatttgctgctcacgtgaaaacgaagaagagcgaaatcaagctgtttgaaacggatcatgatgccaaagcattgctgcaaacatggatagagaaaaaaaggctggagaaagtagcagagctatgggtgaaagggctgcagatagattggaacaagctttatggggaatacacgcctcgccgaatcagcctgcctgcttatccgttcgcggaagagtattactggctgccaactcaagaaggtgaacccgaaaccattgctacagcactccctcattccgaactgatgccaaagcgctgctttctgcgtaaacagtggcagccttgtccgattgaaccggcagaaatgacgaatcaaaccgtcgccattttggcaaatgaggagacaatggcattagcggaagagctttcgacgtatttctcgacataccgtatatttgacatccaagagctggagcgggtatctgctgctgactatgaacacgttgctggagcaatcgatctgatcgggtgcggaacgagccatgagcattctatgggctggataaactggctccaaaagctgatcgagcaaggacgtgcaagcaagcatcatttgacggtcttgggtgtaacaaaggggctggaggcctacgcaaatgagggtgttcttttgtctggtgcttcacgggccggtttataccgcatgcttcaaagtgagtacagccatcttacttcaagacatgcagatatggaatgcgaagcctcttttgaggagctggccagactgattgcagcggagttttatgccaagagcacagaagcagaagtctgttatcgaaacggacagcgatatcgagcatatttggcagagcagccagcagaagccgctctaagtcataagcaagtatcgttttcaacagacaaagtcctgctcattacaggcgggacaagaggtctcggcttgctgtgtgcgcggcattttgtgaaaacatacggcgttaagcggctggtccttatcggccgtgaagagcttccgccgcgtgaccagtggaattcggtaaaaatttcctcgcttgccgagaaaataaaagccgttcaagagctagaagacatgggtgcgcaagttcaggtgctgtctctggatctcacagacagggttgctgtcgaacagagcctgaagacaatacacgaaacaatgggggcgattggcggagtcatccattgtgccgggatggtgaacaaacaaaacccggcttttatcagaaaatcacgagaagagatcggacaggtgcttgaaccgaaagtcgaaggtctgcaaacgttgtttgacctgcttcaggatgaaccattggcgtttttcaccttgttttcatcagtatcagcggccatccctgcactagcagcaggacaagctgattacgcgatggcaaatgcttttatggattattttgcggaggctcatcaagataaatgtcccattgtaagcattcagtggcctaactggaaggagaccggtttaggcgaggttcgaagcaaagctttagaacaaactggattgatcagtttgacaaacgacgagggattacagctgcttgaccagattctatcagacagacagtatgctgtcgtgctgccggcagtaccagatacaaacgtttggaagccggataagctgatgcagccgtcactgcctgtcgaagctctctcgcatcctgagacgaaagagcaaaccggcactcgcaacctgttccctgaaacagtcgactggctcgtaactcttttttcagatgaactgaaaatagctgcagaagactttgaaacggatgaacctttccaagaatacggaatcgactcgattatattggcccagctggtacagcagatgaaccaacaattaaatggagatattgatccgtcaattttgtttgaatacccgacaatagaatcctttgcacactggctcatttcgaaatatgacatatcagctgttttacagccatctgtttctgagaaacagacacctgtcaagccgcaatcagcaatgaaacagaagccggtgccagaacagcggccgcaacagataagccatgaaaaaacggcacttcttgctgaggacatcgctatcatcggtcttagttgcaggttcccgggagcggaaaccctagaggaatactgggaactaatacgtgatggacggtctgcgattgcgcctgttccgcctgaacgattcgggaactccagctcgaattacgcgggcctcattgatgaaatgaaccgatttgatcatgatttcttcatgatgtccgaaagcgatgtcagagcgatggaccctcaagctttggctgtattggaggaaagcttgaagctgtggtatcacgcgggttatacagagaaagaagtgaaaggcatgagggctggtgtttatataggaggccgcagccagcacaagcctgatccggccagtctttcaaaagcaaaaaatccgatagtcgctggcggacaaaactatttagcagctaacatctcacaattttttgacttgaagggaccgagtattgtcctggataccgcttgttcctctgcactggtggggctgaatatggccattcaggctctgcgaagcggagatattgaggcagcggttgtaggcggcgtcagtttgcttgatgctgatgcgcatcgaatgtttcatgagcgcggacttttatgtgacaagccgtcattccatatttttgataagcgggcagacggtgtcattttaggagaaggcgtgggcatggttctcgtcaaaaccgtcagccaagcgcttgaagacggagattccatatatgcagtcattaaggctgctgcgattaataatgatggaagaacggctggcccatcatctccgaatctcgaggcacaaaaggacgtcatgctgtcagcgcttgaaaaaagcggcaaaaagactgaagagatcagctatctcgaagcgaacggctcggggtcggcagtaacagatttacttgaattaaaggcaatccagtccatttaccgttctgaatcaaaggctccgttagggctgggatcggtgaaacctaacatcggccatccattatgtgcagaggggattgcgagcctgattaaagtagctctaatgctgaagcatagacaattggttccgttcctgtcaggtaatgaaaatatgccgtattttgatatagaaaaaacagatttgtatttcagcagatcgcaagccgagtggaaggagacaacgccggctgcggctattaattgttttgcagatggcggaacgaacgcccatctcattatagaagcctggaatgaatcggttgctcgtccaattagaagaaaacctctgcctttgccggaattaaataggcagcccgttttaatcaaaccatcagctcaaaacgtgcaggaaaaagtgcattcagacacaggggcttctaaagatatgttttggaaaactttcaaataagagaggagtgggaaaatgataactgaacaactgcacatttcattaaataatccaatcatgtccaaccacaaggtatatggacaagcgttattacccggccttgcttatatagatttaatctaccaagtattccaggaacatggttatgcataccaagagcttgaattaaaaaacctgaccattttttaccctttgatcgcagatgagtcatatgacattgccctgaccattcacgtgtctgaaagaaaggaagggacatggtccatcatcatcgacggacaaaaacagcatggagaatcactatctgacaagagacaatatgtgactgctgacatgcatcgtaaagagcaaaccgcttttgccgaatcaatagaccttaatcagtggaaaagtacagctgacaggattctgaatttagatgaaatctatgaacaatgccgatctcaagagttagtgcataccggcatgatgaaggcggaaggacagatttatgaagccaaagagggggctttaattgatttagcagttggacaggaagcgttgcgtcattctgatgcttttctgtttcatccgacgcttattgacggcagcggcataggttcaagctgcctgatctcagatcaaacgatgtacctgccattgtattatgaatcgttttctgcttcagaacgattgcaaaaaggatgtacagcacggatcctctcctcatctgtgcaccaaaagaaagaactcacttatatgacgattgaatattttaattcagcaggacaaaaagtggccgagctgaaacaatttgcaggcaaatctgtacggaatgggtcagcctttcattccgcaaaagaaattcaagaagaaagagctgctgtctctcagaacatcagtcaggactatcccgcatttgaaatgtatttgcgtcagttgcttgctaagcagcttgaaaggccggcagaacaaatggatatccacgctgggtactatgagcttggtctggattctccgtcattgcttaccgtggttcaggaaattggagataaggttggagcggatcttgctccgacactgctgtttgaatttacaacaattgcagaactagctgctcatcttgctgctcactattcaattggagaggcggacgatgctgtccgccaatctccttcaccaatgaaggattctcctgatggtgttacctcttcaccagagatcggggaggacattgccattatcggaatggcgggacgctatcctaaggcaaaaacaatacaggaattttgggaacatcttaaagcgggtaccgactgcatcacagagattccaaactcacgctgggagtggaaagaaaacaatggactggattcacctgcaggcaagccactctcgaaatggggcgggtttatcgaggaggctgattgctttgatcctcaatttttcagaatctctccgcgtgaagcggaaatgatggaccctcaggaacggttatttttagagacatgctgggaagctattgaagatgcgggttatacaccagagaaaattgcttcaccgcagggagaaaataaaagacagcatgtcggtgtgtttgccggcgtaatgcataaggactattcccttataggggctgaagctctatcagaacacaatccatttcctttatcgctgaattatgcgcaaatcgccaacagggtctcttactattgtaatttccacggcccaagcatggcggtggacacggtctgctcttcctcattaactgcggttcatctggcaatagagagcatccggaatggagaatgcgaggccgcgcttgccggaggcgtcaatttgtcattgcatccggctaaatatatcagctatggcagtgtaggaatgcactcaagtgacggctattgccatactttcggcaaagacggagatggctacgtatctggagaaggtgtcgggacagtattgctaaaaccgctgcgaaaagctgaacaggacggtgaccgaatctatgctgtcatcaaaggaagtgcgataaatcatgtaggaaaagtaagcggaattacagtaccgagcccggtagctcaagctgatgttatcgaagcgtgtctagaaaaaacaggaattgatccgcgcaccatcagctatgttgaagcccatggcactggcacctcattgggagatccgattgaaatacaggggttagtaaaagctttcagccgcaatacgcaggacaagcaattctgttcaatcggttctgttaaatcgaatattggccatgctgaagctgcagccggcattagcggcttaacgaagactgtcctgcagctgcatcataaaaccttggtgccgtcattacattcagaagagctgaatccttatttgaagcttgatcaaaccccattttttgtccagcatgaaacaaaggaatgggagcagccatcttttacagaaaacggggtggacgtcacatatccccgccgtgctggtttaagttcgtttggcgcttcaggatcaaatgcgcatcttattttggaagaatatattccggccgagagccattctgaaacgattttaacgaaaaatgaagaaatagtgatacctttgtctgcgagaaacaaagatcgtctgcaggcttacgctcttaaacttcttgattttcttagcgaggacgtcaatcttttagcgttagcttatactatgcaggcaggacgggttgaaatggaggagcgtgcggccttcattgtaaaagacataaaagatttaacggctaaacttcgggcgtttgccaatggagaagaagagatcgagggctgctggaccggacgagccaaggagaatcaggaggcggctgggctagcatcggtaaatgcgctgaataacaatttgataacagacagtgaaatgatggaaatggcgaaagcatgggttcaaggaaagcgggtcacctgggacgacctatacggcgatcgcaagccgcttaagatcagtgttccgacctatccgtttgcaagggagcgctactggatcccggttcctgaaatgaaaaccagcactgtgaatcatatcttacatccgctggtgcaccgcaatacatcagactttactgagcagcgctttagctctgtatttacaggtgcggaatttttcctttctgatcatgttgtacagggacagaagattttgccgggcgttgcctatttagagatggcaagggaagcagcggaaaaagctgcaggcgatctggacggcgaacaaagagtggtgtcgcttaaagacattgtgtgggtgcgtcctatcacgatagaaagtgaaccaaaagaaatacatattggcctttttcctgaggataacggggacatttcctttgacatttatagcagctctgaacataaagaagaagccctgacgatacactgccaaggccgcgctgtcatttcagatgaagcggacacttccattttaaacctttcatcaatacagacagaatgcagtttggacacagtgacgtcagaacaatgctatgcagcgtttcgaaagattgggcttgactatggagagggctatcaagggattgaaaaagtctatgtcggcaaagatcaattgcttgcaaaaatctcgttacccgcttttctaaaaaacgacaagcagcattttacgctccacccgagtttgatggattccgcgttccatgccacagtcggttttatcgttaactcagtcaatgccgctggacaagctcagacgctgtctcttccatttgcgttgcaggaggttgatattttcagcccatgtccagagaatatatggtcttatattcgatatagttcagacagtaaagcggaggacaaagtcagaaagtatgatattgatttatgtgatgagaacggacacgtttgtgtgcgaatgaagggtgcctcgatgcgggcacttgatggagagcagcactcaatgccgcaactatcaactgattctcagatgaccgggcatacgatgatgatccctgtctgggaaccggtttcttcagatacggaggataatgcttcgtttgctggtacacgagctgttttatgcggtgctgctgaagctgatcgggcattcataaagcatcattatccgcaagtttcctttatcgatatccggcctgcagatgacattgagggaatagcggtcaaactgcaagcgtacggaagcattgaccatgtattgtggattgccccgtcacatcggggaagtatagatagtgatggacaaggagaagctgttcttcacttatttaagcttgtgaaagcttgcctgcaattaggctatggcgagaaacaacttgaatggtctcttgtgaccgtccaagcgcagccggttacgcaacatgaggcagtacaacccgcccatgcaagcattcatgggcttgccggcacaatggcaaaggaatatccacactggaaaatccgtcttctcgatcttgaaaaaggctgcacatggccggtaaatcacatgtttgcgctcccagctgaccgccttggccatgcttgggcctatcgtaatcagcaatggcatcagcagcaattgatcccatatcggcactcactgtcaggcgacacgctatatcggaaaggcggagtctatgtggtcatcggaggagccgggtatatcggagaggcgtggagtgagtacatgatccgccgctaccaggcgcaaatcgtttggattgggcgaagtcaacttaatgctgccatccagtcaaaaatagaccgactttcggcgcttggccctgagcctttctacattgcagccgatgcagccgataagcattcattgcagcaggcttatgaacaagtgaaaatgcgccatcctcatattcacgggattgttcactctgcgatggttttatttgagcaaagcctggaaaaaatgaagccggaagaattcaccgctggactggcggcgaagatcgatgtcagtattcggatggcccaagtgttccgccaggagaatgtagattttgttttattcttctcttcgcttgtagcccatatcaaaaatgtgaagcaaagccattatgcctctggctgtacatttgcagatgcttttgctcaccagctttctcagagctgggcatgccctgtaaaagtcatgaactgggggtattggggaatagtgaagcggctgaggatgaacattatgtacagctcatgaatcaaatcggcttaggtttaattgagcctgcggaggctatgaaggcgctggaagcactgctttctgggccagtcagccaaacagctttcattcatacgacaaagcctgtagcagtcgaaggcgtgaatcagaatgaattcatcactctttatccagagcaaccttcagcagatgcagagagcctgatggagcgtctgccgactacgggacgatttcaaagagtgacacatgaagagcttgatgatcttctttacaggctgttgttaggacagctgcaaacagccgggctgtttgatggttatacattatcggttgaacgtcttcaacaatataagactcgtgaattttatggaaaatggattcggcaaagcagcgaatttctcttgcagcatggctatcttaagaaagttggagattcattggtgaggaaggaccaagcagaggatatcgagctgctttggctagaatggaacgcgaaaaaagaaaagtggcttaaagacagcgagacaaaggcgatcgttgtattagcagaggccatgctgaaagcattaccggatattttgacagggaaagtccctgcaacagatatcatgttcccgcattcctcgatggaacttgtggaaggcatttataagcataaccaagtggcagactattttaataaagtgcttgccgatacattaatagcttatctggatgaacgtctgaagcacgaccctgaggcatcgattcgcattatggaaataggcgcaggcacaggcggcacgagtgccggaatctttgaaaaactgaaaccatatcaaaagcacatcaatgaatattgctatacagatctgtctaaagcatttttgctgcatgcagaaaaggaatatggggcggaaaatccgtacctgacatatcagctttttgatgtggaaaaaccgattgatcagcaggaatttgaagcgggaggctatgatgtcgtcattgccgctaatgtccttcacgcaacaaaaaatatccgtcaaacactgcggcatacaaaagcggtaatgaaaaacaacggaatgctgctgctgaatgaaatggcgggaaacagcctgttccctcacatcacctttggtcttttggaaggctggtggctgtatgaagatcctgcagtgcggattcccggctgtccaggcttacatcctgacagctggaaagcggcacttgaaagcgaaggctttgaatctgtctttttcccggctgaggcggcacatgatctgagtcaccaaatcgtcgcagcctcaagcaacgggctggttcgccgtatgatgaaaaatgtgatcttgccggagaaggttgtttcacaagcgtctaatcaggagccatcctacattcataccatagattcagaggaagctggacaatcaaaacatgctctcctaagagaaaaaagcacagaatatatgaaaaaactaatcggggaaacgttgaaaattcctgcaagcaaaattgagtcagctgaaccgcttgaaaagtacgggattgattctatcgtcgttgtccagctgacaaatacattacgtaaagaatttgaccatgtaagcagcactttatttttcgagtaccagaccattgacgcattagttgatcatttcatcaaaacaaaaacagaagcgctgatgaaattaacaggtcttgaccgtcaagttcaacaacagacaccggccgaaagcagaacccaatcctcacagaaacctgatcaggccgctaaaagaacacggcgctatcgcaagcttggcttcagcggggagaaagaaacaccgacaaacactcttgcaagtcgtgacgttgccattatcggcatttctggacgctatcctcaggcggaaacagcagaagacttttggaacaacctaaaagaaggaagaaattgtattgaggaaattccgaaagatcgctgggattggaaagcttattacgataaagaaaaaggaaaagaaggatcaatttatacgaaatggggcggatttatcaaggatatggacaagtttgacccattattctttcagatttctccgcttgaggcagaaagaatggaccctcaggagcgattatttctgcaaaccgcttatgcaagtattgaagatgcgggatacacgcctgactcgctctgttcaagcagaaaaatcggcgtctttgccggagtcatgaacaaaaattatccgaccggctacggctattggtctatcgccaacagaatatcctatttactgaatttccaaggcccgagtcttgcagtcgatacagcctgctcatcctccctgacagcgattcatttagcgctggaaagcatctatagcggatcgagtgattgtgccattgccggcggtgtcaatttagttgtcgacccggttcactatcagaatttatctgtcatgaatatgctctctgctagtgatacatgtaaatcattcggcgatgatgcagatggatttgtcgacggtgaaggcgtaggcgccattgtgttaaagccgctgcagcaagcaatagcggacggtgaccatatttacggtgtgataaaggcaagtgccattaatagcggaggaaaaacaaatggatacacggttccaaatcctcatgcacaggcacaggtgattaaagaagcaatggagcgcgccgacattcctgcccgaaccatcagttatttagaggcgcatggaacaggcactgcattaggagatccgattgagatagcggggttaacaaaagcattcgagaaagatacgcaggagaaacagttttgtgcgatcggctccagcaaatcaaatatcggtcattgtgaaagtgcagccggaattgcagggctgacaaaaatactttttcagtttaaatatggccaaattgcgccatcattgcatgctcagcggttgaatccgaacatcgagttcagccatactccatttgtcgttcagcagcaacttggtgaatggaaacgcccggtgattggcgggcaagaggtgcctaggcgcgctggcttgagcagttttggcgccggagggtccaatgcccatatcatcctggaagaatatattccaagaacgggggcgcaaacgccgaaagaacatcctccagcgctgattgtgctgtcggccaaaaacatggaacgcttgcaagaaaaagcggaacagctgcttacagccatcaaacaaaaaaggtaccgcgaaacagacctgatcaggattgcctataccttgcaaacaggccgtgaagcaatggaggaacggctggcctttatagcggaatcactagaggatcttgagagaaagctgaacgattttatcgaaaacaaagcagacagcctgtatctggatcgcatcgatgataacaaaaaagcgttagcagttttatcagcggatgaggatacggaaaaaatcatagaagcatggatgagaaaggggaaatacacgaaactgctggatctttgggtgaaaggcttgtctttcgactggggcatgctgtacggcacccaaacgcctgtccggatcagtcttccggcatatccatttgcaaaagaacgttactgggcaccaggcgcggcaaaggctccggcgtctatagaacaggatcatgatcagcaaacagaagaacctttcaagattatgacttttcaagaagtgtggaaagaagagccggcgactctcacatcgaaacgtatcaaaacgctcatctgttttctgactgaaagagaaaagcaaaacgcatttgcttcagtcctgaaaaacgttgatcaagacaccaaggtcatttttatatcacagggcgaagtgtacagcaaacagtctgaatatagttaccagattgtgcggcaagaacccgttacttttgaaaaggccttccagagcattaaagaagaacttggagagccagatgcaatcctctatatgtggcctatggaagacaagcgctgtataaaggaccattcctgtattgtttacctattacaaggtatgtccgcagcaaagcttcatccttcacgactgctgctggcaggatgttttgaagatagtcttgaccgaagttatctggaatcatggattggcttcgaacgttcactcgggcttgtccttccgcacacaaaagtaactggaatctttcagcccgcggaacaaggatcgatggatgattggacacgtaatatatgggcagaattacaggcttcagctgaacaaacggttttgtatcagaatctgaaacgatatgtaaatcatattgaacagacaacgatacaaccggacaacagcaaattgaagtctggcggtacttacctgattacaggcggtgtaggagggcttggttatttatttgccaagcatttggccaaaaactatgccgcaaacctgattttgacagggaggtcgccttttaatgatgagaagcaaaagcaaataaaagaattaaaggatctaggcggcgaagcgatgtatgcagaagcagatgtgtctgatcctatcgcaatgggagactgcgtaaaaagagggaaagaccgattcggtgccatcaacggtgttattcatgcagccgggatcgagagcgactctgctatttttgacaaaaagatcgaaagcttccagcgcatcattgaaccgaaaatcaacggcacgatagcgcttgatgaatggcttaaaaatgaagaccttgattttatgtgttatttttcttcttcttctgcggttttaggggattttggatgttgtgattatgcgattggcaacaggtttcagatggcttacgcacaatacagaaatgagctgcataacggtaaaacgtttgtcatcaactggcctgtatggaaggatggcggaatgaagatcggtgatgaaggaacaactggtatgtacctgaaatcaagcggccaacgcttcctagaagccgaggaaggcatccgtatgtttgagcacatcctagctcagcaggatgctcagcatctcgtgatagccggtcagcccagccgtgtcagcagatttttaggaatgactgaaccagctattccagaaccggccactcaagcccctctagcacaagaaaacaaggataaggtaaaaacactaagcattgaaaagcgtttagaacacgacttgaaagagcatattcacacattgcttaagatttcaaaggacaagctgaatttgaacaaaaattgggccgacttcggatttgattcgatctatttggctaaattctcgaatgtgttatcaaagcatttcaacatcgaagtgacaccggctttatttttcggctattcgactttacaagaattgatcggctttttcttaaccgatcataaagagctgattgaagcattttaccgggatgatgcatcagaggcgcaaaagccccctgaagcttatgcagcaattcctgtagctttagaaccggaaaccagtaaacaaagcattcggcaggttcacgatgagcctattgccattatcggcatgagcggcaggttccctcaagctgattcggtccatgagctgtgggataatctgaaaaacggtaaatcgtgtatctctgacattccgggcgaacgccgggactgggggagagctaacagagatccagaaaaagcagtgccaaggtggggtgcatttttgaaggacatagaccggtttgatccgctgttttttcaaatatcgcctaaagaagccgaaagcatggatccgcgccagcgcatttttctagaggaagcatggcacacgtttgaagacgccggctatatgggagatcggataaaaggaaaatcctgcggtgtttatgtaggtgtggaagaaggggaatatgcgcacctaaccggagattcggattacattaacggaacacaaaacgccacattgtctgcgagaatcgcatacgcattggatttaaaagggcctaatatggctttgacagcagcatgttcatctggacttgtggcgattcaccaggcatgttcagctctgcgtcagggggattgtgaaatggctttagcgggcggcgtcagcttgaatatttctcacatgtcttttgaggcgctgacaagggccgaaatgctgtctccgaacggacaatgcaaagtgtttgaccaggatgccaatggtcttgtgccaggtgaagcggtggctgctgttctcttgaaaccattatcaaaggcaattgaagataaagatcatatttatggctgcatcaaggccagcggcgtgaattacgatggcaaaaccaacggcattactgcgccaaatccttttagccaggcagaattgatcgaaaatatttatgaaaaaaatgaaatcaatccgctcgatattcaatatgtgatggcgcacagtaccggctcgaatcttggtgatccgcttgaggtccaagcgttaacgagcgtgttcggcaaatatacgaagcagaagcaattctgtatgatcagctcaattaaacctttaatcggacacacatttgcagcgtcaggaacggttgctttaatcagtatgctgatggctatgaaaaaccagatcattccggccactcatcactgtgaatcggaaaaccagtatattccgtttaaagaaagcccatttgtgctttgcaaagaaaaccgttcgtggatcagaaaaaatcagaagccgaggatgggaacgatcagcacgactggaatcagcggcaccaatgcacatgcagtcattgaagaatacattccggaagatcagccgcccacacagcggcatcaagggtcaccgcaggtcatcgtgctttcagcccaaaatgacgatcggcttcaggatgctgcctgccgcatgattgcgtatctggagcagaatcataacctttctttacctgatgtggcatatacgcttcaggttgggagaaaagccatggaagcaaggctagcgatcgttgcaaacaatcaggagcaattagtgcgaaaattgaaggaatatgtggaagcaatgaagaatggtgggatatcgggccaacagagatccctttatacaggatatacagaagggatattagaagaacaagatgaagcagttctgcaggctctcgcaaaagaaagaaatttggaaaacatcgcggaatgctgggtgaaaggatatcagattccttgggaactccttcatgatggcgatcacgttcgaatggtttctttacctggttatccatttgcaagggagcggtattgggtttcgtcaggcacccagcaatcagtggccgttaaacagcattcacaagatatgaaaacagagattgacgagccgaatggcaaaacccatattcaaaagatcattgttcaatttttagcacgagaattgggcatatctgaggatcgaatcaatttcaaaagaaactttttggattatgggatggattcaattcttggccgaaaattgatgcggcatatcgaaaaaaccacgcagctgaagatggccggtcgggaaatccttgaatgtcagacagtccaagctctatctgaccatttggccttaaaagcggaaaaacaaaatcatagcgcagcagcacatcacataaaggacacgtatacagacgagcaaatcatcggattaatgcaagaggtggcgatagggaaattggattttaagagtgtgcaaaacatcatagaagggagtaaatcgtatgaatcataaagaaattctcgatgccttcagatcaggagaattaaccatttctgaggtggaagaacatcttaaaggcatgaagcggcagttgaaaagcccgctttcagaagggcaaaaagggctgtggatgcttcaaaaaatgtctcctgggatgagtgcatatcatattcctttatgctttcgcttcagcaaaccaatacatgcagagacgttcaagaaagcccttctgtttgtacagagacaatatccggtcttagccagtgtgattcaagaagagaatggcattccatttcaatcggttcagttatcaaaggatctttattttgtggaagaggatatatcagcaatgaaatcagcagatattttgccttttctaaaagaaaaagcaaaagaacctttccagttggaagctggtccgttatggcgcacacatctttttcaacggttagaagaagaatgcattgttcttctaacaattcaccatatcatatttgatggtgtgtcgatgctgacattgatatcggcgctatttgaagcgtatcgacaattgctgaatgggattgagcccttgcagcagccattaacagctgattattacgattttgtcgattgggaaaaacggatgctgactggcagagaaggggaagagcatctcgcttactggaaagaacagttgtctgggagtctgccagttcttgatttgcctgctgaccgtccgcggtcttcagcacgaaaattcaaggggcaagcttataaaagcttgctccctcatcacctgaaaaatcaaattaaatcgtttgcccgcaccaatcatgtgaatgaatcggttgtttttctctccatttacaaagtgttgctgcatcattatacaaaacaaaaggatatcattgttggcgttccgacaatgggtcggcaagaagacagatttgaaaccctaatcggttattttatcaatatgatggctgttcggagcaagaatatcggatctcagccattaacagcatttattcgggaacttcagctgacagtggctgacggcctggatcatgcggcgtttccgttccctgcattggtaagagagctgaatgtagaccgctcggccccggattctccggtttttcaaacagcttttctgtaccaaaacttttttcaggcaacaggcttgcaaaaagtgctcgaaccgtatcaaacgcttggcatcgaatatattgaagacattcggcaagagggtgaatttgagctggcgctcgaaatatatgagcaagaaaatgaaacagtgcttcatcttctgtacaaccctgatttgtatgaactgtcctccattgaaagcatgatggagaactatatgaagctcgcgcaacacatgatggatgacccgtctttgccgcttgaagcctactctttgcgattaaatcaagaacaaactaatttggtggaacaatggaatgcgacagggacaaacatcgcaaatgacaagtgtatacatgaggtgtttgaggaaaaagcgaaacaaacccccgatgcggttgctgtgatgtttgaagacagatcacttacatataaagaagtagatgaaaaaagcacatctgtggcagtctaccttcaacatcagggtgttagacctgaacagcccgttggcatttgtgcagagcgttcgtttgatatgatcatcggaattttaggaatactgaaagctggcggagcgtatgtgccgttagatccaagttttccgcaagaacgattagagtacatgctcaaagacagtcaggcatccattgtcctcacccaacctaacgttcatgataggatcatcggattaactggcagccatgtaaaagcgatcaatatcgagttagcttgccgaaacggttatacagaccagcaaagcagcggtttaaagcgggaagtaaaaccggaacacctcgcttatattatatatacatcgggaagcaccggagagcctaaaggggttatggtagagcatcggagcattatgaataccctgaattttcttgaatctcactatcctgtaacggctgaggatgcatatttattgaagacgaactatgtgtttgatgtatcgatctcagaattattcggatggtttattggagatggccgtctagtgattcttccgcctaatggggagaaatcaccgcagctttgcatggattatattgaaacatataaagtgactcacattaattttgtgccggccatgctgcatgtttttttagaaatggcgaaagacaacaagcgattcacagaggacggtccgctgaagtatatgatggttgcaggtgaagccttccctaaagaattagtgaaaaaggcggtatcgctctttaaaaactgccgtgttgaaaatatatacggaccgacggaagcctccatttacgctgcgtatttcggatgcggaaaaggagatatcgcaagtcaccatacaccgattggaaagcctgtttccaacacgaaaatttatattgtggaccagcatttgaaacctgtcccgatcggaaagcctggtgagctttgcatcgctggagccggcttagcaagaggctattttaaaaagccggggcttacggctgaaaaatttattgataatccctttgaaccagggacgaagctatataaatcgggtgattcagcaaggtggcttcctgacggcaacatagaatacttgggacggattgacagccaagtcaaaatacgcggttttcgcgtcgagctgggcgcaatagaaacaaagctgagtgaatttccgggcattttagatcaggcggtagtggtgaagcagctggagggccatcaacagctcgctgcttattatacagaggaaagcggacatgcctctgccaatccaaaagatttgcgccttcatctaaaatcgagtctgcctgaatatatgataccttcacactttatccgcttagatgagcttccattatcgcccagcggaaaagtgaaccgtaaagaattagaaaaacgcgagatcgtgttcaacagaaggaaaccaaatcacttgcaattaacggaaatagaggatcaggtgctgcgcatttgggaggaaacgctcaaggtcagcggatttgggccggaagacggatttttcgatgcgggcggcgattcgcttctggctgtagctgtggctgaacgaatcaaaaaagaattcgattgtgagtttcatgttactgagctgtttgagttttccacgatccgtgcaatcagtgaatacattttggagatgaaaaactcagatctagccgggacacaaaatgaagatcattatgatatcaaaaaagatagaaaacacctagaacagaagattcccccttattttgatgacagtgttgcgattgtggggatatcttgccagttcccgggtgcgaaaaatcatcatgacttctggaaccacatcaaagaaggcaaagaaagcatacgattcttttctgaagaagagcttcgcgcaaatggagttcccgaagaattgatacagcatcctgactatgtgcctgtgcaatctgtgatcgaagggaaagacttattcgatcccggtttctttcaaatctcgccaaaagatgctgagtatatggaccctcagctccgcctcttattgctgcactcctggaaagcgattgaagatgcaggatatgtggctaaggagattccggcaacaagtgtatatatgtctgcaagcagcaattcatatagaacgttattgccgaaggagacaacagaaggacatgaatcaccggatggctatgtctcatgggttttagcccaaagcggaaccattcccacaatgatctcacataagctcggattaaaagggccaagctattttgttcattctaactgttcttcatcactagtcggtttatatcaagcatacaaaagcctgacatcgggcgaatcacaatatgcgcttgtcggaggcgcaacattgcacgcacaatcagcgatcggctacgtgcaccaaaacgggttgaatttttcaagcgacgggcatgtaaaggcgttcgatgcttcggcggacggaatggccggaggtgaaggcgtagcagtcatcctgctgaaaaaagctgtggatgccgtaaaagacggagaccatatttatgccattatgcgcggaataggcatcaataatgatggggcagagaaggcaggcttctatgcgcctagtgtaaaaggccaaacagaagtgatacagcatgtattggatacaaccaagatccatcctgaaacggtcagttatattgaagcacacgggacgggaacgaaattaggcgatcctattgaaatgtctgctctaaataaagtgtacaagcaatacaccgacaaaacacaattttgcggaattggttcagtgaaaacgaatattggccatttggatacagctgcggggttagccggatgcattaaagttgcgatgagtttataccataatgaacttgcaccgaccatcaactgtacggagccgaatccggatataaagtttgaaagctctcctttttatgttgtccgtgtacgaaaatcgttagagaaacacgcaggtgtccatcgggcggctctgagctcattcggccttggcggaactaacgcccatgcaatatttgagcaatatgaaaacatttctgatgcaggtaccgaaaacgaaggcaatcagccttacatcattcctatatcagcaaaaaatagtgaacggctccaagtatacgcgaaggaaatgctgtcctatatcagtcaagacgagcaaaggcatttctctttaagagatattgcatataccttccaagtcggccgtgaagcaatggataacaggatcgtttttatagtgaacgatctggaagagtggaaacatcagctggaagcttttgtgactggaaagccgctcgcagaaggctgtattcaaggagaaaaaacgagaatgacatccgctgaacagctgcttggaaatgctgaagcagatgatatggcttcatcgcggatatcaaaagaagaattgagaaagcttgccgagatgtgggcaaatggctttcacgttgaatggcgcaggctctatccaaatataaagccacgccgcatcagcttgccgacatacccttttgccgaagaacgatactggcctgaaagcagcaccggcgctatcacaacaattgaaccatctcgtttgcatcctttggtgcaccataatacatcggttctgtcagagcagcgtttcagctccattttcacaggacaagagtattttattgccgagcatatcattaaaggcatggcgattttgccggcggcggtcacgcttgaaatggcaagagccgctatagaacaaggaattggcggattggaggatcatgaaactggaatcaggctgaaaaatgtcgtgtgggttcgcccggttgtagcaggaagtgagccggttcaggtaaatatcggactttacgatgaagatggcggacacattgcttatcggatgtatggtgagccggaatccgctgatgcagaaccagttgtatataaccagggtatagcggaattgattcagttaaagcgagaaaaagcactggatctttctaagatcaagaaacaatgtgatcaaagcagaatggatgctgcctcgttttatgaagggatgatcggcgccgattacggtccaggttacaagagtgtagaggccgtatataaaggtgacggccagctgcttgcaaaattatcactgccagaatctgttgcacatacgttgggcgattatgttcttcatccaagtgtaatggacggggcgttacaggcggctgaatatttgcaaaatgtcgtcagagcggaactttcagacactgaagactttaaggcagcactgccatttgccctggaggaacttgaggtctttcgtcagtgcgtttctgatatgtgggtttatgttcaattcaactcgaaaaacaaaccaggagatttgatacagaaagtcgatattcacctatgcgatgagcatggcatgatctgcgtgcggctgaaaggattttcgacgagggtgatggaggcagatatacaaaccgaaccatcaaaaatgaacgctgaaactttattgcttcagcccgtttggcaagaacaaaaggctgctaacagcttagctgcaaaaaaatatgcagagcatctcgtgttcctctgtgaatatgacaatgagacgagagaacagattgaagcagccatcgaggatgtccatgtatacagcctggaagcaaggccttcttcagtagatgggcgtttccattcttatacagaacaagtgtttaaaaaggtacaagagatcattcgtacgaaaccgaaagacggcattctcgttcagatcgtgacctctgccgagggagaacagcaattgttttcagggttgacaggactgctgaaaacagcttgtcaggaaaatgccaaactaaccggccaaatgattgaagtcagcagtgaagaaagtggaggaagcattgctggcaaactgttagaaaatcaaatgagcagcgattcatatgtcaaatatcaaaacgggacacggtatattgctgattggcgtgaaatcaaacaggcaaaaggagacggcagcaagccgtggaaagacaatggcgtttatctcattacaggaggtgccggcggactaggtcatatttttgcaaaggaaattgcggaacaaacgaaaaatgcgacagtcattctggcgggccgctcacctcttagcgaaagcaaaagcaaaaagctggaagagcttcatagcaagggggctgacatcacctaccggcaaacagatgttaccaataaaattgaagtctatcagctcattgacgacattcaaaaaagatatggccgtctgaacggtatccttcatagtgccggaatcatcaaggacagctacctggttaataaacaggcaaaagatctgcacgatgtactggcgcctaaagtaaaagggcttgtttatctagacgaagcgagcaaggatttgcctttagacttctttattctcttttcatctctttcaggaagtttagggagcattggccagtctgactatgcggcagccaatgtatttatggatatgtatgcaggctatcgaaatcggcttgccgacctcagccagcggcatggaaagacgctttctgtaaactggcctttatggagagatggaggcatgcaggtcgatcaagaaactgagaaaaggcttgtacaacttgccggtattgttcctatgagggcagaaaaaggaattcaggcattatatcaagcacttcattcagaggcaaaccaagtaatggtgatcgaaggcgatgtgcagaaaataaaacaaaacacgctggccaaaaacgcctcagcacctatggaaaagaaggaagcagaacacatgactgaacaaataaatagcattgatacagacagtttgctggataaagtaaaggcgatgttaaagcgagagatcgccaagctgttaaaggtcaagcttgaaacgattgatgatcatgccgagatgacggtgtatggttttgattctatctccatgactgaattcaccaaccatatcaatcgcgcctatcagttagagctgacgccaaccgtattttttgaccacccgacgattcatgcgtttggcaagcatttgtcagaagaatatcaatcggtatttgcgaagacatttgctgtgcgcgctgcatcggctcagcttcagcctgctgcgaaacaggaacaagccgtgcgtgccaaagctaaaagacgcagaaagcagcaagtcatgctgccaaacgccatacagagtgatgcagggcctgagccaattgccattgtgggcataagcgggattttccctatggcgaaagatgttgaggcgtactggaacatcttaaaagagggcaaagactgcatgacggaaatcccgaaagatcgctgggattggcgtaaatatgaaggtgatccggcgaaggaagtcaataaaacgaacgtgaaatggggcggctttattgacggtattgcagattttgatccattattctttggcatttcccgcgtgaagctgaacaaatggaaccacagcagcgcttactgctgacttacgcctggaaagcgatcgaagatgcaggatattcggcgaaaaggttgtcaggcacaaagaccggcgtcttcatcggaacgggaaatacaggatacagctctcttctatctaaagcgaactcggcaatagaaggatcagcggcagccaatacgagcccatcggtcggtccgaaccgggtcagttatttccttaatctgcacgggccgagcgaaccgattgatacagcgtgctcaagttcactagtggcaatccaccatgccatctcttcaattgaagaaggcacttgtgacatggcattagccggcggtgtaaatacgattatccttcctgaggtgtatatcagctttgataaggcgggagcactgagcaaagaaggaaaatgcaagacgttttcaaatcaagccgatggttttgcgcatggggaaggtgccggcatactgttcctgaaaaaattaaaagcggctgaagaagcgggagaccacatttacggagtcataaaaggcagtgcaatcaatcacggcggccgtgcagcctctttaacgactcccaatccgaaggcgcaggcagatgttattcagtcggcatatcaaaaagcgggaatcgatccgaaaaccgtgacctacattgaagcccacggaaccgggacggagcttggagacccggttgaaattaacggtttgaaatcagcttttaaagcattgggtgtaaatgaaggagacacatcagtcaatccttactgcggtttaggttctgtaaagacaaacattggccacttatcgctggcagccggtgcagcaggagttattaaaatattattgcagcttaagcataaaaccttagtgaaaagtctgcattgcgaaaccgtgaatccatacattcagctgaaaaacagtccgttctatatcgtacgggaaacggaagaatggaaagcgctgaaaaatgaacggggagaagagcttcctcgtcgggcaggtgtcagttcatttggaatcggcggggtaaacgcccacgtgattatcgaggaatatattccggaagcatccgatgagaatataccatccatcacgccggaacatccgggtatcttcgttttatcggctaaaaataaagcgcggctaaaagaacatgcacagcagctggcagatgcgcttgataagcaaacatatagtgacgtaaatctcgcccgaatcgcttatacactgcaagccggacgggatgcgatggaagaacgtctcgggattatttccggttccattgaggatttacagcaaaagttaaaagactttgcagcggagaaaagcggtgtggaggatgtatttaaaggcaggattgataaaggcacactccaaatgctgacagaggacgaagagattcaagaagccgtcgagaaatggatggaacggggaaagtatgcaaaattgcttgaattatgggtaaaagggcttgatgtagactggacgaaattgtatggcgagaatctgccaaagcgcatcagcttgccgacgtatcctttcgcaaaagaccgttattggatctctgatcatattgaaaaaagcggcagcattgatgcaaatcaagcagcctcccgccttggcggagccgtgctgcatccattaatgcatcaaaacacatcgaatctctcggaacaaaggtttagctctatttatacgggagaagagtttttccttgctgatcatgttgtgaaaggccaacggattttgccgggagtggctcatcttgaattggcgcgggcagctgttgagcaggccgcagaggtacaaggtgtaccgtgtaccatgaagctaaagaatgcggtgtgggtgcggcctattgttgtagaggatcagccgcagcaagtacacattaggcttttaccgggagaaaatggtgagatctcttatgaaatctatggtcattcagacgttactggcgaacagtcaatcgtctacagtcaaggcagcgcgatattgaatcctgctgaaaatctgccggcggttgatttgcaatctctgcgggagcagtgtcaggaaagccatttcagcgtaaacgaagtatacgacacctatcgaatgattggatttgaatatggtcctgcttatcgcggagtgaaaaaaatctatacagctgaacaatttgttttggcaaaattgtcattgcatccgtcagctgcagatacgctcagccaatacaaaatgcaccctgggctgatggattctgctttgcaggcgtcaagcattttgacaggcgccggggataaccagctgacactgccttttgcggtccaggagcttgaagtcttcggagcatgttcgtcagaaatgtgggtatacgcaagatacagccaaggcagcaaggcaactgataaggtgcaaaagcgcgatattgatattttagatgagagcggcaatgtttgcgtacggatgaaaggattatctttcagagcagcggaaggcggctctggatcggcggaatctgatcaaacgctggaaaccctgatgtttgaagaaaaatgggtgcctaaggattttaaaaaagaaagtcctgagcctcattacgaacggcacattgtcatgctttgtgacatgaatggcctctcaaaagatcgcattgaatcaagattgacaggagcggaatgcatcgttttggagtcattccgcgaaggacctgcagagaggttccaagattatgccgaacaagcgcttgagacggttcagggtcttctcaaaagcagacctcagggcaatgttctgatccagctgcttacctctgcacaaagaaagcagtactcattctcagggctatcggcgctccttaaaactgccggcctggagaataaaaaactaatcggccagacgattgaaatcgatttacatgaaaatattgaaagtgtgatagaaaaactgaaagagaataaaaggcacacagaagatcagcacatcaaatatgaaaaaggcaaacggtacatcaatgatctggatgaaatgcaaatagatgatcgggaaataagcatgccgtggagagataaaggtgtatacctcatcacgggtggcgcaggaggacttgggtttatttttgcaaaagagattgctcgtcaagccgaacagcctgtgctcattctgacaggcagatccgcgttgaatgcggatcagcaggcggagcttaacgaacttcagcaattaggggctcgcgcagaatacaggcaggttgacgtgacacaaaccgaagcagcctccgagcttatcacaagcattacgtctgattacgaagacttgaatggtgtcattcacagcgctgggctgattaaagataactatcttatgagcaaaaccaatgaagagctgacacaagttctcgctccaaaggtgaaagggcttgtgaatgtggatgaggcaaccgagcatcttgcgttagatttctttatcctcttttcttcaatatcaagtgttgccggcagcgcgggacaggccgattatgcaatggctaatgcatttatggacagttatgctgcttatcggaatgcgcttgtaaccgccatgtacaggcacggacaaacgttgtcaatcaattggccgctctggaaagaaggcggcatgcgcgcgaataaagaaattgaaaacatgacgttgaaaaacacaggtgtgactccaatgcggaccgagatcggcattcaagcgctgtataaagctttggcatttggcaaagatcaagtcatcgtcatggaaggaatcaaagacatgatgagggaaaagctgactcaaaagccgtcttctgatgatgtaccaatgaaaacagtgcaagtaccggtgacatctgaagcaagaatggatcaagggaatatgttcgaccacattcaagaagttttaaagcaaacaatctctcaattgctcaaaatcaaacctgaagagattgacccggacatggagtttaatcaatatggatttgattcgattacgttaactgaattcgcaaatacactgaatgagaagtacaagctggatcttacgcctacgatcttctttgagcacgcaactgtttatgcatttgcagggtttctgtcagaagaatatccaaatgcttttacagctcaaacgcctgccaaagctgaggtgctgatgcagcctgtcgaacagaatataaaaaacatgacgttttcgactgaaaaccgctttgtaaaaccttcggtaacaccaatgcaaaaggaagctgatcacaagcctgagcctattgcgattgttgggatgagcggcgttttcccaaaggcaaaagacgttgaggaatattggaagaacctgtcattgggcacggattgtattacagaggttccaaaagaccgctgggattggcaggagtattacggagaccctctgaaagaagcgaataaaacaaacgtcaaatggggcggttttattgatgaagtagctgactttgatccattgttcttcggcatatctccgctggaggctgagcagatggagcctcagcagcgcctgttaatgacctatgcgtggaaggcggtagaagaagcgggacactcagctagaagcctggcaggaaccaaaacgggcatcttcatcgggacaggaaacacagggtacagttcacttctgtcaaatgtagacatcgaaggctcagcggctgcgaatatgagtccttctgcaggaccgaatagagtcagttatttcctgaacattcatggaccgagtgaaccgatcgacactgcgtgctcaagctctttggtcgccattcatcatgcggtttgcgccattgaaaatggaaactgtgaaatggcgattgcgggaggggtcaacacggtcgtaactccgcaaggccatatcgcctatgataaagccggggcgctgagcaaagaaggaagatgcaaaacattttctgacaaagccgatggattcgcagtcagtgaaggtgccggcattctctttctgaaaaagctgacagcggctgaacgagacggtgatcatatttacggtgtcattaaaggaagtgcggtaaaccacggtggccgcgcaaattctctaacgactcctaatccgaaagctcaggcggatgtcgtaaaaacagcatatgaaaaagcgggaattgatccaagaaccgtaacttatattgaagcgcatgggactggaaccgagctgggcgatccagtagaaatcaacggcttaaaagcggcatttaaagagctgtatgaaaaaacgggggacccggctgttcatggcagccattgcggacttgggtcagcgaaaacaaacatcggtcacttatcgctggcggccggtgtggcgggtgtcattaaagtgttattgcagctcaagcataaaacacttgtcaaaagtctgtacagtgaaactgttaatccatatatcagactggatgacagcccgttttatattgtgcaggaatcgagagagtggcaggcgcttcgggatgaagccggccgagagctgccgcgccgcgcaggcatcagttcgttcgggataggcggcgtcaatgcccacgtggtcattgaggaatatattccgaaagaaacaacccatcctgcaacagcaccagctgtgacagcacagcacccgggcatctttattttgtcggcaaaggatgaagatcgtctgaaagaccaagcccggcaattagcagactttatcagcaagcgatctatcactgctcgtgacctcactgatattgcttatacactccaagaggggcgtgatgcaatggaggagagattagggatcatcgctgtctcgactggagacttgctggaaaaactgaacctctttatagaagggggcaccaatgcgaagtacatgtacagaggcagagcagaaaaaggtatcgcacaaacattgagatcagatgacgaagtacagaaaacgctcaacaatagctgggagcctcacatatatgaaagactgcttgatttatgggtaaaaggcatggaaataggctggagtaaactgtatgacggcaaacagccgaaacgcatcagcctccctacctatccatttgcgaaagaacgctactggataacggatacgaaagaggaggcagccgcccatcaaacagctttaaaaacagtcgaatcagcagttttgcatccattgatacatgtcaacacatctgatttgtcagagcagcgtttcagctcggcctttacaggtgctgagttctttttcgccgatcataaggtgaagggaaaaccggttatgccgggcgtggcatatcttgagatggttcatgctgccgttacaagagcagtgagaagaaccgaagatcaacaatccgttattcacatcaaaaatgttgtgtgggtgcagccgattgtggcggacggccagcctgttcaagtggatatcagtctaaatccccagcaggacggcgagattgcttttaacgtctatacagaggctgcacacaatgatcgaaagatacattgtcaaggcagtgcttcaatccgcggggcaggagacattccagtccaggatatcagcgtgcttcaagaccaatgcagtttaagcacactctcacacgaccaatgttatgaattgtttaaggcgatcggcattgactacggacctggttttcaagggatagctcggctttacatcggccgcaatcaagccttggcagagctttctctgcctgctggtgtaactcacacactgaatgaattcgttcttcatccaagtatggccgattctgctttacaagcatcgatcgggctaaagctgaattccggtgacgagcagctttctctgccttttgcgctgcaagagctagaaatattcagcccgtgtacaagtaaaatgtgggtgtctgtgacatctcgtcctaatgaggacaaaatacagagactggatattgatttgtgtgatgaacaaggccgagtgtgtgtaagaatcaaggggattacctcaaggctgctggaagaaggcatacaaccgccagacgggccgacatcactaggaaactccaaagcaactcttaacggagcgcctcttatggcgccgatatgggatcgagtgcagctggagaagaggatcatttcgcctgctgatgagcgtgttgtcatcctcggaggggatgacaacagcagaaaagctgttcaaaggcagatcccatttgccaaggagctgtacattgagccgaacgcatcaattcatagaattgcaggacagcttgaagcactcggatcgtttgaccacatcgtgtggatgtctccttctcgtgtgacagagtgcgaagtcggcgatgaaatgattgaagcccaagatcaaggcgtcattcaaatgtataggctcattaaggcaatgctttctttaggctatggacagaaggagataagctggacggtcgtgacggtgaacacacaatatgttgatcagcatgatattgtcgacccggtcgatgccggggtgcacggcctgatcggttcaatgtcaaaagaatatccaaattggcagacaaagctgttcgatgttaaaaaatacgaagacctgccgttatctcaactcctttccttgcctgccgatcaagaagggaatacgtgggcctatcgaaacaagatttggcataagcttcgtctaattccagtacacaacaatcaaccggtgcacacgaagtataagcacggaggtgtttatgttgtcataggcggagctggtggtattggtgaggcgtggagtgaatatatgatcagaacatatcaggcgcagatcgtttggattggcagaaggaaaaaggatgcagccattcaaagcaagctggacagacttgcacgtctagggccagccccgtattacattcaagcagatgcggctaaccgagaggaattagaacgcgcgtatgaaacaatgaaacaaacgcatcgagaaatcaacggtgtcattcattctgcgattgtcttacaagaccgaagcctgatgaatatgagtgaggaatgtttcagaaacgttcttgctgcaaaagttgatgtaagcgtgcgaatggcccaagttttccggcatgaaccactggattttgttttgtttttctcttccgtacaatcgtttgcaagagcttccggacaaagcaattacgctgcgggctgcagttttaaggatgcttttgcacagcggctatctcaagtatggccttgtacagtggctgtgatgaattggagttattgggggagcattggtgttgtttcatcaccggattaccagaagagaatggctcaggcaggcattggctcaattgaagcccctgaagcaatggaagctttggaattgctgcttgggggaccgctaaagcagctagtgatgatgaaaatggcaaacgaaacgaatgatgaagcggaacagacagacgaaacaattgaagtgtacccggaaactcacggctccgccattcaaaagctgcgaagctatcacccgggtgacagcacaaagattcaacaactgttataggaggggaagcgccaatgctgaacacagaagacattctctgtaaaatgcttttcgcacaattacagtccatagggtttttcacagaaagtaaatcccagccggtattggagaatttctatggcagatggttcgaagaaagccaatcaattttagaacggcagcaatttttgaagcgaacggagaacggatatgttccaacacgctcaataggcaccatgagcgagctttggaaagaatggaatgaacaaaaatctgacctgcttcaagacaataatatgaaagccatggtgacattggtggagacagcacttaaagccttgccggagattctgaccggcaaggcgtcagccaccgatatcctgtttccgaattcatctatggatttagtagaaggggtctataaaaacaatcaagtcgcagactattttaatgatgtgcttgcagatacgttaacagcctatctgcaagaacgtctgaagcaagagcctgaggcgaagattcgaatattagaaatcggagctgggaccggcgggacaagcgcggctgtttttcaaaaattgaaagcatggcagacacatataaaagaatattgttatacagatctgtctaaagcttttttaatgcatgcagaaaataagtatggtcctgacaatccatatttgacatataaacgatttaatgtcgaggagccggcgtctgaacagcatattgatgcgggaggctacgacgcggtcatcgcggcaaatgtgcttcatgccacaaaaaatatccggcaaacattgcgaaatgcaaaagcagttttgaaaaagaacgggctgctccttttaaatgaaataagtaatcataatatatattcgcatttgacgttcggccttttagagggctggtggctgtatgaggaccctgatctccgcataccgggctgtccgggcctgtatccggatacttggaaaacggtgcttgagagtgaaggatttcgctatgtttcctttatggctgaacaatcgcatcagctcggccagcagatcattgccgctgaaagtaacggagtcgtccgtcaaaagaagagaacggggcagaagaagatccaagccatatacaaatgaatgctgaaatcgatcattcacaggaaagcgattctctcatcgaacaaacggcacaatttgtgaagcatacgctggcaaaatcaatcaaactatcaccagaacgtattcacgaagatacgacatttgagaagtatggaattgattcgattttgcaggtgaatttcattcgtgaattagaaaaagtgacgggagagcttccaaaaaccattttatttgaacataacaacacaaaagaactcgtcgaatatttagtaaaggggcatgaaaataagctccggacagcattgttaaaggaaaaaacgaagcctgcaaaaaatgaagctccacttcaaacagagcgtacagatcctaataagccatttacttttcatacacgccgctttgttacagagcaggaagtcactgaaactcagctagcaaataccgaaccactaaaaaaagaaaagacaagtaatttgcaaggaacacattttaatgattctagtacagaagatatcgcaataatcggggtaagcgggcgctatccgatgtctaacagtttagaagagctttgggggcatttaatcgccggagacaattgtattacagaggcaccggaatccagatggcgcacatctttattgaaaacattatcaaaagatccaaaaaagccggcaaataagaaacgctatggcggatttttacaagatatagaggcatttgaccatcagctttttgaggtggagcaaaaccgggtgatggaaatgacaccggaactccgtttatgtttagaaaccgtctgggaaacgtttgaggacggcggctatacgcgaacccggctggataaattgcgggatgatgacggagtaggtgtttttatagggaatatgtataaccagtatttttggaatatcccatctttagagcaggcagtcctcagctcaaatgggggagactggcacattgcaaatcgcgtttcccacttttttaacctgaccggaccgagtatcgctgtcagctcagcatgctctagttcattaaacgccatacatcttgcgtgtgaaagcctgaaattgaaaaactgctcaatggcgattgctggaggcgtcaatttaacactcgatctctctaaatatgattctttggagcgtgccaatctgctgggaagcggcaatcaaagcaaaagttttggcacaggaaacgggcttattcccgggaaggcgtcggagctgtcctgttaaaaccgctttcgaaggcgatggaagatcaggatcatatttacgctgtgatcaaaagcagttttgctaaccatagcggcggaagacagatgtatacagctccagatccgaagcagcaagcaaagttaattgtcaagtcgattcagcagtcgggcattgatccagagactatcggctatattgaatcggcggcaaatggttcggcgctgggcgatcctattgaagtaattgccttaacaaacgcgtttcaacaatatacaaacaagaaacagttttgtgcgataggctctgtcaaatccaatctggggcatttagaggcggcttccggtatttctcagctgacaaaagtgctgctgcagatgaagaaagggacgatggtgccgacaattaacgcgatgcctgtcaatccaaatattaagttggaacacacggctttctatcttcaggaacaaacagagccatggcatcgcttgaatgatcctgaaactggaaaacaattgccacgcagaagcatgatcaattccttcggagcgggggagcctatgccaatcttattatagaagaatatatggagacggcccctgagaaagaacatatcgctccccgccagcaggaattcactgccgttttttcagccaaaacaaaatggagcctgcttagctatctagaaaatatgcaattgtttttagagaaggaagcttctctggatattgaacccgttgtacaggctttacacaggagaaaccataatttagagcatagggctgcatttacagtgacatcgactcaagagctgttcgaaaaactaaaggtgttccgaacatcaagagaaagctcactccagcaaggcatctatacatcattcgatttacagccatgtgcggaatcagcatctagggatagagaaataaacgcagcagagcaatgggtacaaggggcatcgattgcttttaaagaagctgatatagggaaccgaacaggctgggttcatctgcctcactatgcatttgaccataatacatcatttcatttcgatgtatcgtctatcaatgagaaatcgtcagatgttgaagacaatattaatcagccggtcattcaagatcaattcacttatgatgagccttacgttcaaggacacgtcttcaacaatgaacgggtgcttgtcggtgccacatatggcagtctggccattgaagcattttttaacctgttccctgaggaaaacagcggccgtatcagcaaattaagttataccagtccaattgtcatcaaacaaggcgagaccattgaacttcaggcaaagccgctgcaaaaagatcaagtcatagaactgcaaatcatgtatcgcgagccgtcctctggtttgtggaagcctgccgcaatcggacaatgcggaatcggttcttttgagccaaaaaaagtcaatatcgagaacgttaagcattcattaactaagcttcatcacatcgatcagatgtataaaaccggaaacggtcctgaatggggagagttatttaagacaattactcatctttacagagaccacaagtctatactggcaaaaattcgcctgccccaaagcgggctggcaaacgggcaccattacactgtaagcccattgatgacaaacagcgcgtacttggctatcctcagtttcttggagcagtttgacatgacaggcggcttcctgccgtttggaatcaatgatatccagtttacaaagcaaacgataaaagaggattgctggcttttgattacattggttaagaatacaggtgacatgctgctgtttgatgtagatgtgatcaatgagtcgtcagaaacagtgctgcactactcgggctactcgcttaaacagcttcgtatttcgaatcaaagaggaaatcaaaataaggccatcaaagccagcaatctgaaagatcgtatcagaagctatgtaacagataaactggcagtaaacatggccgatccgtcaaaattgtctcttgcaaaagcgcatatcatggattttggaatcgattcttctcaattggtttcattgacaagggagatggaagcagagacaaagatcgaattaaatccgactctgttttttgagtatccgactattcaagagctaatcgacttttttgcggacaaacatgaagcatcatttgctcagctgtttggtgaagctcatcagcaggaagaacgcccagctcaaatcgaaaaccaaatgaaacagattccggcatacgagacgaacacggataaaacaatcgaacacgcagcagacggcatagccattatcggcatgtcgggacagtttccgaaagcaaacagcgtaacggaattttgggataaccttatccaaggaaagaactgtgtctctgaagtgccgaaagaacgctgggactggcgcaaatatgccgcagccgataaggaagggcaatcaagccttcaatggggcggttttatagaaggaataggtgagtttgatcccctgttttttggcatatcgcctaaagaagcggcgaatatggacccacaggagtttctgctcttgatacatgcatggaaggcgatggaagatgcaggcttaacagggcaggttgtatccagccgcccgacaggagtatttgtcgcagccggcaatacggatacagctgtgattccttccctaattccaaaccgtatatcctatgcacttgatgtaaaagggccaagtgaatattgtgaagctgcctgttcctcagctctagtggctttgcacagagctatacaatccattcgaaacggcgaatgtgagcaagccattgtcggggctgtgaatttgctgctttcaccaaaaggctttattggcttcgactcaatgggctatttgagtgagaaaggacaggccaaatcctttcaagcagatgcaaatggctttgtcagaagtgaaggagcgggagttctcatcattaaaccattgcaaaaagccattgaagattctgatcatatttattcggttattaaaggttcaggtgtatcgcatggcggcaggggaatgtcacttcacgcgccaaatccggccggcatgaaggatgcaatgctgaaggcttatcaaggagcacaaattgatcccaaaacggtgacctatatagaagcgcatgggatcgcctctccattggcagacgcgatagaaatagaggcgttaaagtctggctgcagtcagctcgaattggaacttccacaggaagtacgggaggaagcgccatgttatatcagcagcttaaagccgagcatcggacacggtgaactcgtctcaggcatggctgctcttatgaaggtcagcatggcgatgaagcatcaaacaataccaggcctatccggattttcgtctttgaatgaccaggtgtcaataaagggcacccgtttccgagtgactgccgaaaatcagcaatggggggatttaagtgacgatgcaggcaaaaaaattccgcgcagagcgagtatcaacagctatagctttggaggcgtaaatgcgcacgtcattttagaagaatatattcctttaccaaaaccaccggttagtatgagtgagaatggtgcccacattgtagttctttctgcaaagaatcaagacaggctaaaagcaattgttcaacagcagcttgactatgtgaataaacaacaagcactgtcattacaagattatgcttatacactccaaaccggccgagaggaaatggaagatcgcctagcgctcgtcgtccgcagtaaagaagaactggtaatcggcttgcaagcctgcttagcagaaaaaggcgataagccgaagagttctgtacctgtctttagcggaaatgcagaaaatggctcgtcagatatcgaagccttgctggatggtccattaagagaaatggtgatcgagactttgttgtctgaaaacaaccttgaaaagatcgcgttttgctggacaaaaggggtgcaaatcccatgggagaagctttatcaaggaaaagatgcccgcagaataccgttgccaacctatccatttgaaaagagaagctgctggaacggctttcaagcagtagagagtacgccttctgtttcacaggatgagcgtatcaacaacagcagcgatcatcacatattagcaactgtactagggatggatccggatgaactgcagcctcataagccattgcagcagtatggatttgattcaatttcttgcatacagttattacggcaattgcaatcaaaggtggaccctctcattgccttgacggagcttcaagcatgccatactgttcaggacatgatggacttgatcgcaaagaaacagaaggatacatccttacaaaatgatcaagctcgcacgtttccggaattgataccgttaaatgacggcaagcgggggcgccctgtcttttggttccatggcggagtaggaggagttgaaatctatcagcaatttgcacaaaagagccagcgccctttttacggcattcaagccagaggattcatgactgattatgctcctttgcacggaattgaacaaatggcttcctattatatagagatcattcgatccatacagcctgaaggtccttatgatgtaggcggatattccttaggcgggatgattgcatatgaagtcactcgccagctgcaaagccaaggccttgctgtcaaaagcatggtgatgattgactccccatatcgttctgagacaaaagagaatgaggcatctatgaaaacgtcaatgctgcaaacaattaatatgatgctggcatcgattgcgaaacgggaaaagcttacggatgttctcatcagccgtgaagaggtggacataagcttagaggatgaagaattcctgtctgagttgattgacttggcaaaagaacgagggctaaacaaaccagataagcaaatacgtgcgcaggctcagcaaatgatgaaaacacagcgcgcctatgatttggagtcgtacactgttaagtctctccctgatcctgagacggtaaaatgttattatttccgcaacaaaagcaggtctttctttggtgatttagacacttatttcactttatcaaatgaaaaagaaccgtttgatcaagctgcctattgggaggaatgggagcggcaaattccccatttccacctggtggatgtcgattcaagcaaccacttcatgatattaaccgaaccgaaagcgtcaacagccatgttagaattttgcgaaaagctctattcaaacaggggagtagtgaatgcgaatttccttaaggctttccggaagaaacatgaagcgagggaagaaaaagaaacagatgaattggtgaagcgctaaaaacacaaacgccccctcttttaaaagggggcgttttgaatgttattttgaaagagaaacagggagactttctaatcctcttaaaaagacattttttctccattgaatgtcatcaggcgcaaccgcaagttcaatatcaggaaatctcttcaaaagtgcgttaaatgcaatgtggccttccagcctggcaagaggcgctcctaagcagaaatgaatgccaaaaccgaaagaaatatgtctgttaggcgaccgatttatatttaatatttcggggttctcaaaaaaattcgggtcgcgattggccgatccgatccctataaaaatcatgtctcctcttttgatcgaatgccccttatatgtaaagtcttcgatgacccaccgatttgccatcataacgacaggtgaggtgtatcgcagcaattcttcaaccgctgtagcgatcatttcaggatgctgcttgagcttctcacattccttcttgtgctgcagcaatgcgagggtgcctgagccgagtaagttaacagtcgtctcaaggcctgctacaacgagcaagaacagcatcgaatagagctctttttcgcttaacttgctgccgttttcctcagcatgcacaagtttgctgattaaatcgtctcttggctttattcttctgtcatggatcagcttggagatataatctttaaattcacgaagagcctgatttgtcagctctctgttaccttcagaggtatcaaccatcgcattggtccagatttgaaactgtgaccgatcttcttttgggattcccatcaattcagatataacaataaaaggcaaaggggaagcgaaggatttcatgatatccgctttattttctttttccatttcatctaaaagctgttcagcaatttgttcaatgctgccgcgcagattttcaatggttcggggagtaaatgcttgatgaacaagtgatctcaggcgggtatggtcaggtgtgtcttttgccagcatatgatcggatacaaaatcgatatcttcactaacgttgagcattttgatttgttcttggttcatcacattttttacgtctcttgtaattcgattgtcttttaaaaaggccatacaatcatcgtatcgggtaattaaccaggccggatatgtggctccgaaccgttttaattcaaatcggtgaatgggctcttcctctctaaatcgtcctaaaactgaaaaaggattgtgatgaaactctttaccatgcggatgaaacatcaatttttccatttgcattctcctcgcctaatagggtaaatagatgaatcaaattgctgaactagtttacaaaaaacagaatgatttgaaatgtaatcctgtctctaaaactatatatctattttaggagtcattcaatagggtgaagaacgaaaaaagtgaaaaaacggctcgatataaagcagcgcctttgaacgaaagctcaaaggcgctacgctgtattattttgatgaaagtggctttcagctgtgctggatatcaattgtatatactgcacgatctgttatgaccttcaatccttcgttttcttggtgaatatgaatgtcacctaataaaggaatctcataggcattttgcggaagcggtacgtttccgtcctcagtgaatgttgttccttcgccttctaaaacgagctcttctttcgcaacataatcatcaggatgattcgtactgcgtatagccactttttgaaggtggagaacaatctgatccaagtctgatatctcttcatcatgggtcaattcaccttttctaatatcaagcgtctggccgacttttgattccagccattgagaaagctgtttattcgtgtgtgccatcaatattcctccttttgatctacacgatactattcccaattgctgcatcttttacacggaaaagagccgcctcactctttatgtatgaaacaattcgctgttgagagccttgatatagcgtacggcagaacgctggaccgcttcgccggcattttctttgacaactttagaaaaagcattgtaaagccggttgaattgaagcggttttactttggctgctatttcttcaactttggaggcgggaaggggaatgagatttgggtagctgtacataaagctgacccagtttcggtccgccgcaaccgtaatgatatctccggtcaatagacagcctttcccttcattgcccttgctccaatgcaaaacagcaccgcctttaaaatgtccgcccagtcggtaaaggtccagtcccggcttcacgttgagcgtttcccctgaccagaagtgaatgtgattgcttggccttgtcacccattctttatcatcctcatggatatagatcggcgcctgaaacgcttcagcccactcaacttgagtagagtaataatgtggatgagacaaggcgatggcttgaataccgcctaattcgttgatttggtcaattgtcttttggtcaagatatgtcatgcaatcccacagcacattgaagcccttatgctggataagatgagctgtttgtccgatcgcaaactctggttcagttttgatgctgtaaagatgctcttcttcctttttgaggatgttttgaaggtttcctttctcacgcatgtcttcaagggttgtccaactttgtccatcgggatgaatatactgcctttcatcctcgcaaatcagacacgagttgggcggatctacagtctgtgcatgttgcacaccgcatgtgttgcagatataatatggcactttcttcacttccttcatctattttccattattttaccttatgattatgaatattcaaacaaaaaaccggcagttctgctgagagagaattgccggcttttgatgatgtttattggccgggaacggaattttctgcgttgacagcgcccgctccgtacacatttggatcttcatctttccatttgtccgtgccgtttttcaaaagctcttttacttcatcaggggtaagatccgggttgtgctgaagaattaaagctgcgattcctgcgcaaatcggtgttgccatcgaggttcctgacattgtaaagtactgagaccctacacggcttgacttttggagcttatcaatataagaattcggagagcgaagggaaataatattaacacccggcgctaaaatatcgggcttttctttcccatatactgtcgggccgcggcttgagaaggaagcgacagtatcatcatcgctgcttgcagtattgttatcgtcaagcgcacctactgtaatcaccttttcgctcacgcccgggcttgcaatggtctgcgaatcagggcctgagtttccggcagcgacacagacgacaatccctgcgttccacgcttcttcaaccgctctgactaacggatcttcctgttcatgatcatatctaagggcatcgcccccgagcgacatgctaataatatcaatcggttcatcggggttgtcctcattgtattgaatacaccactcaacaccctctataatatctgctaacgttcctgaaccctgcttgtttaatacctttacgccgatgagattggcttccggtgcaggtccgcggtattggccggaagaggatgcgccgctgcttgcaacatcacctgcacagtgtgtgccatgaccattatcatcgtacggctctgttttttgattgaccatgtccgcgaatccgataattctgccttctagatcaggatgcgggtagattcctgtatcgacaacagcgacagtaacaccttttcctgtcagggtttgcccgtttctgacgacttccttcgcatggcttgcttcggttgccgtgtctaaaagcgctttgacttcgcggtttaaatacactttacggatattgctgcattcagagagaagggaatgtaatgctgaaggagtaacctcggcgctgcagcagttgattttgttgaagcggctttttagcttgctgcgtttttctttttgcagcacctctccagccatttgaaagccggtctcgtgacagccttcctcaaattcgataatgactgacattttttttctgttttgcaatttggtttcgaaaaatttatgcaagaagcaaggagtccatttgaagggcttgtaaagctgcaatacggtttcccgtaacggccaatctagcttgtgagcatttgctctcaccatttgtaccatagagtacccaaacatgtattttcctcctattataaggttctctgtatactctatgaacagatgataggtttggtaagtttgtttgtcctctgtaagagacagacaagagtttgtttttctgaatctttcgcattagatacgatagattcagaagctgaggaaatcattggggattgaaaaagaacgtttgttcgtattataatgtgatcatatcaaactgggaaggggagagcaaccgtatgaatttctacttgcaccgatctttggaaagccaaatgccaatcagcattatatatatgaagaaagacggaacgattagtaaaagaacgattattgtgagacagaaaagcaaaacgaaaatcaaagcattttgtttttcgaaacaacagatcagaacatttttattggactctatcctctcctgtgattttgtgagaacaaataagcaaaatctctattctgcaggccggtaacagctgtccgtctcagcaaccgggcagcctgttactaaaaccctccttaaacctatatacatttatttgccaagtgaggttgttcctaccttttttgtctttcctctcaaccttttttcactcttatttgaaatgaaccgctaataaccgtgacaatcaattgattttttgaaaccgggaactttttcactgatgatattgtgtatacaatggtaagataaaacctattggctaaacctcatataatgaaccgcgccattcttatgaaaggagttaaacatgagaagatttttactaaatgtcatattagtcttagccattgtcttgttcttgagatatgttcattactcattggaacctgaaccatcaaatcagcctgatacatattcaaatttcagcagcttggcagagaatgagagcccagccgattacgatatttcatataatgagaaaaaaggaagcaaagtcttaattatgtctccgcatggcggaagaattgaaggcggagtaagtgagcttgtgcgttatttcaataatgaatactctacatacctgtttgaagggttgaagtcccacgataaccaaacgctgcacattacaagcaccaactttgatgagccattggctaaaaagaaaatcaaggagcatcaatatgtggtggcttttcacggatataaaggagagaacaagaatacgcttgtagggggaacagaccgaaagcgagcgaaaatgattgtgagagcccttgagcggagagggttttccgctgagttagcgtcgtctaaaagcggtcttgctggattgaatgccgaaaacattaataaccaaggggaaacggggctaagtatccagctggaaatcagccgtgagcagagagaagcattttttgatgatttttattataaaaatagaaaatacacaaagaacagtgaattttatgcttatgtcagtgcgatcaaaggtgtcctggaaaaagagtattcgtaacaagcagatcagaagacaaaataagagaagatcagtagactgaaataggataaaaaaggaggcaaaacaatggcagatcatcatttttatttaaaagcgaattggccgggtaaccgcaatgatgtcggtacgattgaaagcggaaacctgatcacatcgatttccattcctaaagaaatggatggcccgggagaagggaccaacccagatgaaatgcttctcggggcggcagcgacctgttacattattacacttgcagcgatgatggagagaagcgggctggaaaaagaagacttacagatggagtcagaaggcattgtcgacgtcacaaaaggagtctttacatacaaaaagatcattcaccgtccctctgtcgtgcttaaacatgatgcttcacaagacgacgtcgcattggcgcacaagctttgtaaaaaagcggagtcgtcatgcatgatttcgcgtgcaattcaaggaaatgtcgagctgcagcttgaagcctctgtgaaactgggtggagaataaagaaaacagacggtcactcacagaccgtctgttttttatcttcagcgtgggctttcgattgatttagcacgaccacgcctgcaatgacaagcgtgagaccgaatacaccttttaaactgatggtttcgccaaaaagcaaaaacccgacaattgctgtaagcgcggtaccaacgcccgaccatgttgcatacgcgcttgataagtcaattgtttttaaagaaaagcttagaaacgtaaaagcagaaagaaatccgactatgactccggcaatgggccaggcttgtgtaaatccttctgaaagcttcagcatcgtgctcccaaacacttcagatacaatggcgagagccaaataaagcaatcctctcatcttcatcactcctttactgccaattaagtaacacgacccctgatagtaataaaagaatcccgataagccctttggcattcagatcttccttgaaccattttactccgatcactgtcgtcagcaccgtgcccgccccgctccaagtcgcataggagaggctcaggggaatatggtttaaagtcagggacagcatataaaaggcgagggaatagccaatgacgaccaaagcacttggcttccactttttgaagccatcagatactttcagcatggctgctcctatcgattccgaacatatggcaatcgtgaggaatatatatcctatcaacatcataaattctcctcactatatttttagattagaaaaaaacttcagctagaaaaatagtagtgtatgcctatgtatgagtcaagagattcattttcacacacttaaaaagacccctttttaaggggccttttgcgtttaataataataagggaacggggcatacggataataggggtatccgccataaaaataaggattaaataaagcgcttcctataagcccgcctgcaaggccgccgataaacggtcctccaaaaaatccgaatggccggccaaacccataaccaaatccgggtcttccaaatccgtaaccgaacccgaacggtcttccaaacccaaatggtctcccgaatccgaacggtcttccaaatattcttgtatcttcagggctgaaatgctctaactcgttcatgttttctttcctcctgtaataaagtgtagatgatgcagtgtattcaccctgcccggatttgattgggcgaatcgaggaaaaggaggatgtgaacacattgggcctgtatcagtctgactggtcaaaagcaccgccccacgcacatgcctatcatgtcaaaacaacgagagaacagggccattatcatctcattgaagggtttactcagccggcaaacggatcaaataccgatcagcatacacattactatacagggatcacttcatttgaaaacggccattttcatcggtattacggaatctcagggccggcaattcccttagcagatggcacacattatcatgaaatcgaagaaacgacgtatctggcctacaacgagccgattgagatccagtacggaggggttgtgtacgatcccggagatgacagaagaaaaacgcatcgtcataccctgaaaggaaagacaagggaaattgtcggcaatgagccgcttggctggtagaaggatgtttaccgatgcaaaaaaagggcaaaatggataggtggttgtccatgttgaatgctataatggggggagatttataaaagagagtgatacatattgaataatacgaagcagcccgttgtcattttagtcggaccgacggcagtggggaaaaccaatttaagtattcagctagccaaatccttaaacgcggaaattatcagcggagattcgatgcagatttataaagggatggatattggaacagctaaaattaccgaacaggagatggagggagtgccccatcatctgattgacattttagatccccaagactccttctctaccgccgattatcaaagcttagtaagaaataaaatcagcgagattgcaaatagaggaaagcttccgatgattgtcggcggtacagggctttatatacaatctgtgctttacgattatacatttacggaagaggcaaatgatcccgtgtttcgagagagcatgcaaatggctgctgagcgggaaggcgctgactttcttcatgccaaacttgccgcagcagatcccgaggcagcagctgcgattcatccgaataatacaagaagagtcattcgcgcactggaaattttacatacgtccggaaaaacgatgtcccagcatttgaaggaacaaaaacgagaacttctgtacaatgcagtgttaattggcctgacaatggatagagacacgctttacgaaagaattaatcggcgggtcgatatgatgatggaggcaggccttcttccggaagtgaagcgcttatacgacaagaacgtgagagactgtcaatcaatacaggcgataggctataaagagctgtatgcatattttgacggttttgtgacactttctgatgctgtcgaacagctaaagcagaactcgaggcggtatgcgaaacgccagctgacgtggtttcgcaacaaaatgcaggtcacatggttcgatatgacaccgcctgttgatatggagctgaaaaaaaaggaaattttcacacatatagcaggaaaactcgaactttaatcgaaactgtatgatatagagaatcaaggaggacgaaacatgaaaccgattaatattcaggatcagtttttgaatcaaatccggaaagaaaatacgtatgtcactgtttttttgctgaacggctttcagttgcgtggccaggtgaaaggctttgataactttaccgtattgttggaatcggaaggtaagcagcagcttatatataaacatgcgatctcaacgtttgcgccgcaaaaaaacgtccagcttgaactcgaatagatcaaaaaatgccatgtcaagacatgaggaaaggctgccgggggttcccggcggccatttttaacatgaatccacttttgctccaagctttttgtgtaagctgaccatgccaaggcacggtctttttttatgagaacaacatacggaagtgaaaatggtatattatgtataaaatgaatttgggagtgatcgaccttgtttgaaagtgaagcagaactgagacgaatcaggattgcacttgtatggatagctgtctttttactgttcggggcgtgcgggaatcaagataccattattgaaacagacagcggcaattcagactatgaaacgcctcagcccacctcgtttccacttgaacataaccattttggcgttatggaggacggctatatcaaaatttatgagtataatgagtcccgcaatgaggtaaagctgaagaaagaatacgcggatgatgagcttgaataaaattcacaagcattcgaatttacaaagcggattccagccgctaaactaaatacagacacagatcaaacagagggtgaaaacatgaagcataaagtgatcgtgaatcattgggaagaaatttgcgaagatgattcttgctatgaatacggaacaagtatcattgtgaacggaaaagaattaatcagagaagcgtcaattatcactgctttgaaggcggttttagaagagatcggcgcggatgttgaaatagaagaaacagtagagagcgaaaaatgctgtgatagcttaagaaaaaaaaatctagactactaagcagttttttttcatgttatgataaacatcggctaaaaaacgacaccccgagtaggacgagagatgattctcgttctgctctcttttttgggccctaatgagtctgcccatttgcctgatttgatcaaaatatgaatttttcataaaaacgaatctatatattgtgtttttgctagagggtagtatactatatatagtgttagtgatgagagattcatattttttgataggtcgtgataaaacgtggtacaaatcatatttgattcgaaaacagggaatgttcagcggtttgtgaataaaacaggttttcagcagatacgcaaggtggacgaaatggaccacgtggacactccgtttgttttggtcacctacacgacaaacttcggccaggtaccggcatcaacacaatcatttctcgaaaaatacgcccatctcttattaggagtcgctgcgagcggcaacaaagtatggggcgataactttgcaaaaagcgccgataccatttcaagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaaaaagatggaaaattccagtttgataaggataaagaggctgtacatagctattttgtagattatatcaatcaaaacacagtcttctttcacgatttaaaagagaagctggattatttggttgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgctaacggcgacactgagaaagcaaaagaatatgtaaacctgatgatcaatcaagaatatcagccgagcacaccgacatttctgaacgccggcagaaaacgccgcggtgaacttgtgagctgcttcttgctggaagtcaatgattccttaaacgacatttcaagagcgatcgatatctccatgcagctttctaagcttggcggcggggtttctcttaacctgtccaagcttcgcgcgaaaggtgaagccattaaagatgttgagaatgcgacaaaaggcgttgtaggcgtcatgaagcttcttgataacgcgttccgttacgctgaccaaatgggacaaagacaaggatccggcgcagcgtatttaaacattttccaccgcgatatcaatgattttcttgatacgaaaaagatttctgcggatgaagatgtgcgtgtcaaaacgctttcgatcggtgttgtcattccggataagttcgttgagcttgcacgcgaggacaaagcggcttatgtattctacccgcacacgatttataaagagtacggccagcacatggatgagatggacatgaacgaaatgtacgacaagtttgtcgacaaccctcgggtgaaaaaggaaaaaatcaacccgcggaaactgcttgaaaaattggcgatgcttcgttctgaatcaggctatccatacatcatgttccaagataacgtcaataaagtgcatgcgaataaccatatttccaaggtcaaattttctaacctttgctctgaagtgctgcaggcatctcaagtttcttcatacacagactatgatgaagaagatgaaatcggtctggatatttcctgcaacctgggttcgcttaacattctcaatgtcatggagcataaatcaatcgaaaagacagtcaagcttgcgacagactctttaacacacgtttctgaaacaactgacatccgtaatgcgcctgctgtaagacgggcaaacaaagcgatgaaatcaatcggcctcggtgctatgaaccttcacggctaccttgcgcaaaacggcattgcgtatgaaagcccggaagcgcgtgactttgcaaacacgttctttatgatggtgaacttctactccatccagcgttctgcggaaatcgcaaaagagaagggcgaaacgtttgatcaatatgaaggctcaacctatgcgacaggtgaatactttgacaaatacgtttctactgatttctcaccgaaatacgaaaaaatcgccaacctgtttgagggtatgcatatcccgacgacagaggactgggaaaagctaaaagcatttgtcgctgaacacggcatgtatcacagctacagattatgcattgcgccgacaggctctatctcatacgtccaatcaagtacggcgtctgttatgccgattatggaacgcattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgtgatttaaaccgaatcgatctgtatgcacatcatagaggaattaaaaccatttactatgcaagaacgaaagatactgggcaagacagctgcctttcttgtgttgtttgattaaaggagagtttatagtgacaaaaatttatgacgcagcaaactggtcaaagcatgaagacgattttacccaaatgttctataaccaaaacgtgaaacagttctggcttccggaagagattgctttaaacggcgatctcctcacatggaagtaccttgggaaaaatgagcaggacacttatatgaaggtactggccggacttacgcttcttgatacagagcaggggaatacggggatgccgatcgtggctgaacacgtagatggccaccagcggaaagcggtgctgaactttatggcgatgatggagaacgctgtccatgcgaagtcgtactctaatattttcatgacccttgcaccgactgaaacgattaatgaagtatttgaatgggttaaacaaaataaatatttgcagaaaaaagcgcaaatgattgtcgggctttacaaagccattcaaaaagatgatgaaatttcactgttcaaagcgatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgatcgaccttctgaatcagttatatgaaaatgagcttgagtatacagaggacttgtacgatcaagtcggactctcacacgatgtaaagaaattcatccgctataatgcgaataaagcgctgatgaatcttggatttgatccatacttcgaagaggaagatattaatccgatcgtattaaacggattaaacacaaaaacaaaatcacatgacttcttctctatgaaggggaatggttataaaaaagcgacagttgagccgctcaaagatgatgacttttattttgaagatgaaaaagagcagatataatatctgctcttttcggcttgaaggttcaaatgaggaggacgcagtacccatgggaaaaatggacgaaatgattttagttgccccgcgcgatgatgtgtttaagaaagaaagcttaaccttccagggcgtgtacagtgaagatagcagagtagccgaaatcatggctcagattgaagcggcctatcgtgaaatgagaagaggggacgcagaagaagatccgcgtttcaagcagccgataccttatgtcgtcattaagcgtgaagatgaagtttttctttacgagcggctggctggcggcggtgaatcacgactgcacaacaagctttctctcggctttggcggtcatatgaacgccatcgaaggggcagcttcatttgctgaagtcttaaagctgaacacagaccgtgagcttgaggaagaactgcaaataaatgaagaagataaacaggcgattgtcacactgggattgatcaatgatgatgaaaacagtgttggcaaagtgcatatcggtattctttctgcgcttcaattaaagcctggcgcacaagtggaagtgaaggagaaagaacaaattgcgggtaaatggatgaaagtttctgaattaaaacaggatgacatctataaccgtctggaaacatggtcacagtttgttgttgatattcttgaataaaaagacccggtttctcgcgatgaggagccgggtttttttatgagacgctcgtccccgtctcggctattctaggatcacaatagcgtcaaagccggcatttttcgctctggcagcgagggtgtctgcattgtctttggatgaaaatgcgccaatctgcactttgtataatccgtcctttaaaaggacaatcgagtcaaaacctttggcttcggctttacttgcgagcgagtcggcattcgctttgactttaaatgcgccgatttgaaccttatataaccctgagctggaagtctttttaaggttaaaggcttgctccagcccgtttgcatgtcctctcgctaagctttgaataaaactgctcgttttcagcttatttgcatcggcaacggtatcaatgaaaccgttctcggtcaagagggcaggcattgccgactcccttaggacgtggaaattcgctgtttttttgccgcgatcggcaaagtcgacagcttgtatcacttcagagtgaattgtcgattgataagtcgtcgtcggggctcctacatctggataaatatagctttcaaaacctgtgcctcccccggaattaacgtgaatggacaaaaagaaatctgctccccagttatttgcggcatttgtccggtcgtttaagctgacatattggtcgcttgtccggctcagcagcagagaaacgccttcatattcattagttaatatcgtacgtaaggctaaagcgatttgcagggttaacgttttctcctgaaggccattacctgttgcgcctggatcagacccgccatggccaggatcaataaaaattttaaccatttttcatcacctcattacaggatatgaaaaaacacggcttctgcttgtacgattatcattcaactgaaaaatgaggaaataaccctttcaaattcggaaattatttctcgggaaagcgcacaattcaacatgaagcgacaacagatacgatccgacatgaaatctgtgcatacgccatatgtttgtatgtactatgggttcggttaacctgcactgattcctgctggttttaagctttgcgttcatattaaatcaagcatttgaaacgttaattgatgagaaaagctcctttcattaaagataccactttataaatcgaaaaaaagaaaaacacttcaggtatcttacggagggtaatacgcttcatacaaaaaaacagcccgttgcatgaaaaaaggattggcgaatggagaaaataatgagaaagaagctcactataatactctgacaaaatgattaaaaacaaaatatcatggtttgtccaccccatgtccgtgaatacaataagaaataaagtatttctcgggaaagcgcaggattccttattgttcccgaaagaagcaattgtttcgacacatgataggcgtttgtcacaatcggcatccgcttgaatatcatatagagagaacagagaggtgaagatgttggagcgcgctgtgacttataaaaacaacggacagatcaacattattctgaacgggcaaaagcaggtgctgacgaatgctgaggcagaggcggaatatcaggctgcattgcaaaaaaacgaagcaaagcacggcattttgaaggaaatcgaaaaagagatgagcgccttagttgggatggaggaaatgaaacgcaacatcaaggaaatatacgcctggatttttgtgaaccaaaaacgcgcggagcaaggcttgaaggttggaaagcaagcgctgcacatgatgtttaaaggaaatccgggaacgggaaaaacgacggttgcacggctcatcggcaagctgttctttgaaatgaatgtcctgtcaaaaggccacttaatagaagcggagagggctgacctggtcggggagtatatcggacacaccgcccaaaagacgagagatttaatcaaaaagtcattaggtggcattttgtttatagacgaagcctactcgctggcaagaggcggcgaaaaggactttgggaaagaagcgatcgacacacttgtaaagcatatggaagacaaacagcatgagtttattttgatactcgccggatattcacgggaaatggatcattttctctcgttaaatcccggactccaatcaagatttcccatctccattgattttccggattactctgtgacccagctcatggagattgcgaaacgaatgatcgatgaaagggaataccagctcagtcaagaagctgaatggaaattgaaagattacttaatgacagtgaaaagcacgacaagtcccattaaattcagcaatggacgttttgtcagaaatgtgatcgaaaaatcgatcagagcacaagccatgaggcttttaatgggagaccaatacttaaaaagtgacttgatgaccatcaaaagccaagatctttccattaaagaagaagcatctggatctgcatagacctctctgtttttgagaggtctgttttttgctcgtatttccgcttttcaaagcaatcgatttgtggtatacacatgcagggtttggtatgataatactactgcccaatatgcaaaagaaaggaacatccatttgaacgaacaagaaacgattcaggagaaagccattttagtcggatgtcagctgccgcatatcacggatgagcattttgaaaattctatggaagagctagcatctctgacaaaaacagcagacggaaaagtactgaccagcgtcacacaaaaacggaacagggctgacgccgctacatatataggaaaagggaaggtagaagagctgaaggcactggtggaagagcttgaagctgatctcctcatctttaatgatgaactgtcgccaagtcagctgaagtcattggcaacagcaattgaagtgaagatgattgaccgcacgcaattgatattagatatttttgcaaagcgggcgagaacgagagaaggcaaacttcaaattgagctggctcagctgcaatatgcactgccgcgtctgacgggacaagggatcaatctctcccggcaaggcggaggaattggggcaagaggtcccggggaaacgaaactggaaaccgaccgccgccatatcagaaatcgcattcatgaaatcaacacgcagctttccactgtcattcgccatagaagccgataccgtgaaagaagaaagaaaaacggtgtgcttcaaattgcgcttgtcggctatacaaacgcagggaaatcaacatggttcaaccgcctgacgagtgctgacagctatgaagaagatctcctgtttgccacgctggacccgatgaccagaaaaatggtcctgccaagcggctacagtgttcttctttcagatacagtaggatttattcaggatcttccgacgacattgattgctgcattccgctcaacgcttgaggaagtaaaagaagcggatttgatcctgcatttaattgattcttcaaatgaggattatgcgggacatgaaaaaacagtgcttgggcttctcgaggagcttgaagcagatgatatcccgatgctgacggcttacaataaacgtgatcaaaaactgcctgattttataccgtccgccggaagggatcacattatggtcagtgcgaaatttgaggacgacgctgcagcctttaaagaagcgattcagcgctatttgcgccaagaactgctaacgtcttttgaagcacatgtgccggcaagtgaagggaagctcctttccagaatcaaatcggaaacgatggtagaccgcttctattttaatgaagaaaatgaacagtatgacatatccggctatgtccaagaagagcaaagtatcatcggtgaattaaagaagtatatgtaggaaggaaatataaagacatgtttgacacattaacacacggagaattattgaagaaaacggcaatggaagtggaagcggacattgccggcattcataaacaaatagaagaaatcagcgagcgaaatgagtggagagtgcttcaaagctatagaaaacacaaagtaagcgacactcatttcacgccgtctactggatacggctatgatgatatcggaagagacacgcttgaaagcatatatgcggatgtgtttggcggagaagcggggcttgtaaggccgcaaatcatttcaggcacacatgccatctcaattgctttgttcggtgtcctcagaccgggggacgagctcctttatatcacgggcaagccgtatgatacgctagaggaaattgtgggcgtcaggggtggagaaaacgctggatcgttaaaggattttcaaatcggctataatgcggttgatctgacgaaagacggaaagatagactatgatgcagtcgccgctgcgatcaatccgaagacaaaagtaatcggcattcagcgctcaaaaggatatgcgaatcgcccttctttcttaattagtgaaataaaagaaatgatccgttttgtaaaagaaatcaatgaaaatctgatcgtctttgtggacaactgttacggagaatttgtggaagagcttgagccttgccatgtcggagccgacctgatggcgggatctctcattaaaaatcccggcggcggccttgcgaaaacaggcggctacctcgtcggaaaagcgaaatggattgaagcttgctcataccgtatgacgtcacccggcatcggcagagaagcgggggcatctctttactcgctccaagaaatgtaccaaggcttctttttggcgcctcacgttgtgtctcaaagtctaaagggagcggtgtttacagcgagattccttgaaaaactcggcttcacttcaaacccgaaatgggatgcgaaaagaacggatttaatacaatccgttgagttttctgacagagaaaagatgattgctttttgccaggctattcaatttgcatcgccaatcaatgctcatgtgacgccttatccagcctacatgcctggatacgaggatgatgtcattatggcagcagggacgtttattcaaggagcaagcatcgaattatcagctgatggccctatccgcccgccgtatgtagcgtatgttcagggaggattaacctattcgcatgtgaagaatgccatatgcagtgcagtggattcattgatggaaaagcaattaatttaaattttttaaaaatttctctggatttgatgttaagaatccttacatcgtattgacacataatataacatcacctataatgaaactaagttaagaaaaggaggaaattgagatgagtgataatattcgccgctcaatgcctttatttccaataggaattgtcatgcagttaactgagttatcagcaagacaaattcgatattatgaggaaaatggactgatatttccagccagaagtgaaggaaatagacgattattttcatttcatgatgtagataaactgttagaaatcaagcacctgatagaacaaggtgtaaacatggcaggaattaaacagattctggcgaaagccgaagccgagccagaacaaaaacaaaacgagaagacgaaaaaaccaatgaaacatgatctgtccgatgacgaactgagacagctcctgaaaaacgagctcatgcaagccggccgttttcaaagagggaatacattccgtcaaggcgacatgtcccgcttctttcattaatccgttagcaactgttttgctatatacatttaccttttaagaggaggaattttaccaaatggcaaagtacactagagaagatatcgaaaaattagtaaaagaagaaaacgtgaagtatatccgtcttcaatttactgacattcttggaacaatcaagaatgttgagattcctgtaagccagcttggaaaagcgcttgataataaagtcatgtttgacggttcttctattgagggattcgttcgtattgaagagtcagacatgtacctgtatccagatctaaatacatttgttatcttcccatggacagctgaaaaaggtaaagtagcacgtttcatctgtgatatttataatccggatggcacacctttcgaaggtgacccgcgaaacaacttaaaacggattctgaaagaaatggaagacctcggcttcagtgattttaaccttggacctgagcctgaattcttcttattcaaattggacgaaaaaggcgagccaacgcttgaactaaacgacaaaggcggatattttgacttagctccaactgatttaggagaaaactgccgccgcgatatcgtacttgagcttgaagagatgggctttgaaatcgaagcgtctcaccacgaagtagcacctggtcagcatgaaatcgactttaaatatgctggagcagtccgctcttgtgatgacatccaaacatttaaactagttgtcaaaacaattgcccgcaaacacggcctgcatgcgacatttatgccaaaaccattgttcggtgtgaacggttcaggtatgcactgcaatctatcactcttcaaaaatggtgttaacgcattctttgacgaaaacgcagatcttcagttaagtgaaacagcgaaacactttattgcaggtatcgtgaagcacgcaacaagctttacagcagtaacaaacccgacagtaaactcttacaaacgtcttgttcctggctatgaagcaccttgctatgtagcatggagcgcgcaaaacagaagcccgcttatccgtatcccggcttctcgcggcatcagcacacgtgttgaagtacgcagcgttgacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttcccgcaacacttgcggaagcactagaagaattcaaatcaaacgaagtcatggtcaaagcgctgggcgagcacctattcgaacacttcatcgaagcaaaagaaatcgaatgggatatgttccgcacgcaagtacatccttgggaacgcgaacagtatatgtctcaatattaatctctcaatcccttggcactattggtgtcaagggattttttgatttattaaacaatttaataatttaatatagaccatgtaacaccagacaaaagggcgaagaaaaacggcattgccggcgtgtatggtccgaaaacagcaaacgcggtccaacggttccagtcagtatgtggcctttctgctgacggcatttatggacctaagactaaagcgaaaattgaagcgaaattgaattaataaaagaagcccttcttaaaagagggctctttttctagctatgttgttttaaggtgttttctaatttgttcagtgacttgcttaagccattccaagggtgttataccatcttcaggaaagtatataccatccgctgcttcctctataaattcattcttgtcttcttctgaataatcactatttaaaaactcagttagtactattaaatctctttcttttagtttttgtgatgcttcatttagatattcattaagagcatcttcaggagattctatatcttggtggaaatgtcagccgagaaatctaaatacaggatcagaaactttaatttcaatcattgcttatatagcctcttttatttctataattacttttttcaaccattgtaaaggagttaaatcgattgccggaaaataaatctccgtatatgattttataaaactttctttctcttgatcagatatgttttcatttaaaaactcttcacaaaattttattgtgaaaactaagcattctttacttgattcagctataaattctttcaaagcttgttctggtgaacccatgtcctggtgaaatgttccttctaaaaaatcacttaattcttccagagtatcataattctcgtacattgttattcagaactccttttattttgtaggatagccagttaaaataaattccccatttttactctttttcaatactattgtagcgttggtagcatccttagcaacatttgaacctttttctactcttctgccgagaacttctccatcacctttgtatcttaaaggaagagtacgtctactgttaggattagagagccatttttttattttagtaatgttttttggatcacttagaactgaactggcgactttttctgcagtagctctatctttaaatgaagaagacccagagatttctgtatcttttattaaacgttgaaataattcgccatcagtctccccgacatgtctttctataagatgcccgccttttgcttcatgagcagctaacccgccgccaggtgcgagaggggtactatcaccttgtttgacattacctatacctatgttgttagaagtttcagattttctgagaacactctcttttttatcttccgcaatactttttagcaacggagtatttttcacgttaatggtattctcagcatcttgaaggatcccttctaatgcaggagtataccgatttacaggagatttgacaaactgttttacagatttaccgccttttttaattgtgccaccagttgctttcccaactttagcaagatctttcgagcctgttgagacagaggactttccacctttcaacaacaggagacttccgcccaaataagtaacatagtgcagccgtgtgtatgcatccccgtgaatcatttttgtatcccaattatccttcaatgtgtcaaccatactttgaaaggcagcttgatagtcgtattccaaaacggtatccagcacttttttaggatccttgtttaagttatcaatcgtccaaccgatattccatccaaattgaatggctccttcaccggtatccttggcaagatcgtatataccaacaatcgcccccttggcgccatcacctatgattttcaacacttcttttccgttatccatgaaagctttacgctgttcaagaaatgaaacaaattcaagctgttcaggggtaagattctcatagccgaccttcttggcaatttctaagtattcatccggatccgtcactccgtcagctagcttcttctgtttctcgttctttcgcttcatctttcttgatcttcaaataagcttcagtctgtttctcaatatcgccttttttcttatgtatgtcactttcacggtacgccttggcgttgtagtgaatgggcgtagcgtttttcccttttcctgtggactcctcaagcttttggaagtctttcttgatgaattgttcgtttggctcagactgggtgtattcacgctgcctaatttatcaactgtttttttacgtttgttttccgcatcagcaagttcgtctttgaagttttctgtcgagaacaaatcaagcggaagaatatcgtcgatatcatgtaagatatctttcatggctttcttttgttcagacataattgattttgattttgtgtaggcgttagccagctcgtgttctaagaaggattcttctatatatgcatcagataagctggcgtcttctaaagtgcctgaaatgctcgtcaagaaagcaattttcatatcaagtaagtcaatccaattgtcagccacacctgcatggtcttgataaaatgctttaatgttgtcggcgcctttgccggaaaactcactgtcatctagatcagctacagctttaaaagccttttttagattgaccatctgacttcttaattctttgtattcctttgcacgtctatctgcttctgaaagcagtgatttggcttcaaatactttcatgatcatatcctttcgtttgaatatctccaacaagattttaccatgggaaaatgaagaaatagacaaggatgtgattcaaaagtgagaaatgattaatttgatctgtgtcattttacctatctgaattaattgaagaccgtttacgcagtcaggcggtttcagtccatgcatggatatcgcataacaaaaatagccctttagcaccttactttttttgttaaaatgatgaaaacagcaaggggagataatatggcattactacgctttataagtttatatggaatagccatcattatactgatggtcatagcgaattttgctccttttttggcgatgccattatactatgttgccatggctacattagtctttctgattgtttatctgatatatcattattcccaaaagtttagaggggggaaaaagtaaacaagcaaaaagaattccaaatatttttttgcgcaaatttcgcacaaaaatatggttataaatcctattaaatcaattatttaataggggtgataaactccctcctaggtagtaagcatattattcataaaacatgcttttgaccaaaattaagaccaaaatttgaccaaaaaaattaactaatcatacttaatgtaatacaaatctcaacgaatgaatttgctgaaacgcttgataagtaagggttttgattgttatagattagctattttatctaaagaatcatgttccgcacgcaagtacatccttgggaacgcgaacagtatatgtctcagtattaatctttcaatcccttgtcactaaaggtgtcaggggattttttatgttaataggtaataaattatggagcggcactgctaaaaagcagggtcacttttagtctatgtcactaataattctatgtactaaattttcaattagggaaataattccacgcttaaggaagcaatacgcataaataattcgacaaattctgtgataattccattgttcaatacttctaccagcaataataagatgagtaaggtagatgtttatcattgacatcataaccaaatgaatccataattacgttgaaatctaaatcaattttcaaaaaggagatttctatgaaaaaattgactatcttctccgggggattaggagcggttttttctgtactggctcaactgtttgcggttatagatgactcttacactttggggaatttatggtttttaggtgctttggcgggaattataaccatgcttgcttcaatccagacaaataataaaccagtcttcagcatattattaattgctagttcagtaataggtctacttggaactggtcttgtatacatcataccaacacttttcaatataataataatttataaattttcaaaagtaagccaatggtaaaataaaggttctttttttatttagtatccctttgacaaggtcggtaatgaatcgcagaatgttgcagctagggcttccgtgggcatgattatcgaacgccatgtttctaggataccggaattgaaacatttgctgagacatttcgtgaagctgatcaccaaatgaccattttcatagaggcacgtctaaagaagctatcataggaggacaatactgtgtggaaagctttaagtcaattactcaagaaacagaaaaatcaaagtccaagcgatgaagattatatacagattccagaattagaagtaaaagttttggggatgcttcacagtatcaatatagacttggttaatttaatagctcaagcagaaaagtctaaggagtttataggacaaatcgaaggcatctggcattctatagcaaatcaattttattcactcgcccaagggtttgagaatgaggatatcaataagctttctgcggatcttgatcatgctgccgccacttgggaaactgttgctaataaagcaaaagagtttgtaacaaattcataccatgggtaaaagaaaaataagggcctgaaagggctcttttgcttatagtcatatttcccgtaagtattactttttggatgtattaaattttaaagcgtgtttgtttcactgaattcatagtcaaaaggggaatgtttttatgcttggaatcaacgttgaaaaatcaaatgaaaacttaattatcaattggcagctatccaaaattgaaattccaatcaaagaaatcaatgatgtatttcttgatccaaactatggggagaggagaaaagcgcagtaaggattaggtttccttatggctcaacagatagggtagtaattaaaacagcatataacacttacattttgttcaccactaatcctgctttaattatgagtaaaattgtttcttaataaacagtttatgtcccttttaaatttatcttaatgttctgtgtggtaaaatttagtgagatgatttaaggaggaggagcatttatggaagaaggaaagttagttcacatgacattagatggtattaagaaagcagttactaaatatggtacatttcctgtgttccatcatggggttatgtcttggaagatgctacttttcatttcaaaaatccagcaactcctcaagaaattagcggcttagaaaagaaattaggtgttacttttcctaatgactttaaagagtttttgttacaacacaatgggatggaaatgtttgatggcattgaaatacttagcttagagggaatcgttgaatataatgaggttcaagatttcccagagggatacttattaataggatatcattttgatggaaggtatgtcatagacacaaacaaatcaaaaaaaggattaggttatatgttatatctagactcaattgacgatattgaagatgcgattaacttaaattctaatttcgagatatggtttgatatgctagtgtcttctaatagaacgaaatattgggaagtaaatccgaatctccaagagtattataaactggtttcagaataacacttcggcaaaagaaaaaattatgactaatttcaacaaccaaagattctgctatttgagggaagtataatgacaatttacgagcaaattaaagatgctttaaaaaataagatcaatgagttgctttcacctcaagaagtaaagaaaacccttcaagaaaaatacggaactaacggatagcattattttatcagattattgttataaccggtataataaggggatttcttttaataagcacctctttgaatatgtgaatagaagttcttacaaatacttaggtgaaaactctctttatacaggacttattttcagaaaatcaaaaggggaagataaggaagttatcgtaggcgaatgggtaaacggtgttaaatcactccgagaagtacctattactaataaccaaatacatgatcaagccgaaatcattagtaaagaacaacttgtaaacctttataatgaatataaccaaatcttgagatatgaaatgaatgtattgaactgtaagcccacagaattgaggcatttaattggcagaatcggtgaattcatttgtgcaatccaaaccaacggcactctggcacgtcaaactaatcagcatggatttgatgttgtgagtgatggcaggcggattagtgtaaaaacaacagctcaatcaagtggttttattttgataaataaaaatacatttgatgattttgatgttttttttgtagttcaatacgtaaatgatgattttaaagttattttcttcggctcaaaggaagaagtgcaaaaaataagcagagtttatggaagccaatacgaagttgaaatttcacttcttaaaaagcttaataaggaataccaattaaattaaacaatcttgttgataacaaacattctcttacttattgtaaggggatgtttgtttaatccttattttatcttcgcaatctggcttacgagttgcatccacagtaaatgatcttacttcgtcttttccccgtgttacttttttctattgagataaccattgattttaatgccgctcattgggtttacctcataatcatcagtgtaatcgtaatcaattgattcaatatctttatcgtttgttttaataaagccaagccagtcattagccaatgaatacaactcttctttttgcagagctacttggacttccattttttgttgtgttgttccttcataattgtccctcagagaagggtaagggaattatttttgagaatcatattccattgcttgttcacagtcagaaatccttgagttgttctagcaagaggcaatattgttgaataaggatagttttaaagaggttattgttgtcttcatattgaaataaagattaagtatattagaggggagttgctttaatgcacataacaacaaaaaggttattgatacgtgaatttgaattcaaagattggcaggctgtatatgagtatacatctgatattaatgtgatgaagtatatacctgaaggggtttttactgaagaagatgcaaaggcatttgtaaataaaaacaaaggtgataacgctgaaaaattccctgtcatactaagagatgaagactgtcttataggccatattgttttttataagtattttggtgaacatacatatgaaattgggtgggtgtttaatccgaattatcaaaataaagggtatgcttctgaggcagcccaagctatcttggaatatggatttaaagaaatgaacttacataggattatagctacgtgtcaacctgagaatattccttcataccgagttatggagaagattggaatgaaaagagaaggattttttaaaaaatgtattccaaaaggcaatgaatggtgggatgaatattattacgctattttagaggaagagtggaattgtaagagggataatgcaggaaattgaaaccataacagctatagaacgtatagtgatagtagggcttatagtgcttaatatgaatgatgtgagaggggtatccaaatgcaaattcatctcaccaaaagcggaaaacaagacaatcatcataaatggttaggaactgtcttgctcagttggggaacattcgtatttgctttgttttttgctactttagttggttcaatggctagccaagcaggagcttccaagcttttgaagcatggcatccaagctggtttagtcacattaataactgtcccgttgctctacattcttcttaaacggatgtctagtagacccttttattctataggactgtctgggtggcggcaagctattccgaaagccattatgggagcaatatatgtgattgtattatccgggtctggtttcgctatcgcccatttattaggctggatcaaagttacacaatttcacttctctgtccatttagtgacagcattgctcttaaatatgattatcgctttcttttatgaagcttttccagaggaattaacttttcgggggacggtgtactatgctctaaataagcgttggaactgttttatggccttactcctacagccgatcctgtttgtgcttgcaccaataactgtaagtggcttgcaatatatagctggaattgaatcacctgctatcacattagattacatcgttttattgttgacttttggatgcatccttcaactcctccgtattgtaacaggaagcttatggacgtctatcgcttttcatctagcctttcttgaaaattctcggttcttcgtcctgcagggggaggagcgctttattacctatgaagaaattgttccgggaacaggttcgctgtttgtgatcttttttatgttgcttattgtcggtactctactattaatacctgttgcaataactcgccgaaatactattcaatggcggaagaatgagaaatgcgaccaagatgtttaatttctgagtagaacagtagttttaaagtgattttaaggaggatctagacaatgttgaagaagcattcctgatgaaagattagtagattttgattctcaaggtggaaaccttattagtttttttttagttactcactgtgagttatctgatcaatcgtataaaaatgtattaagctttaatgatgatcttttgggtatgaagcataactgttcgtatgcaatggatattctaagcgttaaagaggaatttgatttcgatttcccatttaatatgcttgcaataaaaagctacgtacaagaattaataaaaatgttagggattgatataactctgcctgaaatgaaagaaagagattttgacaaactttctcaagattaaataaaactacgattttaaagagaacggagacttgctttcaatatgaatgttaaaaaaactgcagctattttttcaatcacgattccaattatctcagctatcctaattattaatttttttacgggagttatgtcaattccatggcaaggaatgccggtgttttttccattattgctttctcctataggaatcattttagcgttcgtttcaatgaagacaaataaacggtgtgctgtatatgggattgtcttaaatgcaattatgtttccatttccttttttctggtttatcggaggggctttgttatttggagtttaatccattaggcattacgcttatacattggtattttcgagcttgtcaaaagaaggaataaaaaattttcagaattgcttggctttactttattttgaaaggggtcgagtaagatggataggaaaaaggatgaaatacaaagaaaatataaggaacaaatgagggagaagaaagaacgagaaaaagaagatggcagttcacatacttttgaaattgttgttgtgctagccattatcattttgatgtttttctttaattcagttttcaaggctttttagatattgtacagatgactttcaggatgtttgaaaaataaccctttgagatatataccacatgaaagtattgaaggacttatgaaaattcaagagccagttgaatcttaataattaatcaccaaataatggggatgtaaaatgaaattgtataatgaatttatcaatatagctaaaacgtttaataaagagttagacataattccattattatatggatctttaggtcttgaaaaggtaactgggttagacttttccccagaagatattgatatccttattcctttaatttttttagaggaaaagtgggaaaaactaaaaaaagtgatggaactgcatggatacaaaatggttgatttacatgagcatgaatttaagaaaactaatacaaaaataggcattgcttacattgaggatttaaaaccatttgcagatgtagactataataacctagaggtttttgaagatggcggagcgaaatatcatttgctaacgattgatgattacctcaaggtttataaaaagtctttattagatggttatagaagaaggaagaagaatcataaagaccaaagtaaaattaacatattgaataaattaatacggaattaatttctgtattctcttttgtttccagtctcaattaaaatttttaagattaaaataagtttgaaaggataaatcatagtgtttaacacagccattaatcctcagacagtcaaaaagccatttctactccggttgaaagcttctcaatttttgcttcttatttatctttcctgtattgatatatgtatgtagggttggacttataacataaactattctgccattcctgttctttcaattcatgaccgggcttgccatcagcataaatctaggataacagtctccatacatcctgtgatcacctttatcaaactcttaaatgcaacttaccactaaccaattccttatttcgcatagatcatctttgtcatgtgtttacacaagaatctgttttggactaatcgtcgttaactgatacatgacattcgcaaatatttgagacactgaatataacgaaacagtcaaaaatcaatatttaattcattctgtttaaactttctgaaaaagatgttgaaaaagtcgagaggattttataatattaaatcaagttagtttgttcgatcgacaaactaacaagatgaactttcattgtccacaagataaggtcttactgaatatggatggaaggggataagagggtcgatttaatggagctaaacaatataagaaacgaaagaatgaggcttttatccttttccaggtatataaggtatgacgaaaaaagatgaattttctgcttgctgatcaccatatttttttgcactgttttgaaagcgcttttataaaagtttactgaccgtaaattcgagaaattgttataccgtttcacactgttccatattaaaggatcgaaaaggggagaaatcatgctcagtgaaaatgtaaagaagattagcatggttgaaaaagttggatatgcgtctggagattttgcttgtaatttaatttatgcaacagtgtctacttatcttttgttcttctatacagatatttttggtttatcggcagcagcagccggtactatgtttttagtggttagaataatcgacgctctcgctgatccttttatcggaacaatagttgacagaacgaacagcagatttggacgctttagaccgtatcttttattcggagcttttccatttgtcatactggcaatactctgttttacaacaccagacttttcggatatggggaaattaatatatgcctatataacctatgttggcttgtcgcttacatacacaacgataaacgttccatatggcgcgttaacttctgcaatgactagaaataatcaagaagtggttagtataacttctgttcgcatgttatttgcgaatcttggggacttgtcgttgcattttttgttcccttactggctgcttatttaagcgatacttccggcaacgagtctcttggctggcaactaaccatgggtattttgggaatgataggcgggtgccttttaatcttttgttttaaaagcacaaaagagcgggtcactcttcaaaaatccgaagagaaaattaaatttacggatatatttgagcagtttcgtgttaatcgtccacttgttgtattaagtattttctttattattatttttggagtgaattccatcagtaattcggttggcatttactacgtaacgtataacttagaaagagaggatttggtgaagtggtacggtttgataggaagcttgcccgctttggtcattttaccgtttattccaaggcttcatcaatttttggggaaaaagaaattactaaactatgcattattactgaatattatcggcctcttagctttactgtttgttccgccaagtaatgtttacctcatacttgtctgtcgattaatcgctgctgctggaagtctcactgccgggggatatatgtgggcgcttattcctgaaacaatagaatatggagagtacaggactgggaaaagaatgggtgggctcatttacgctatcatcggatttttctttaagtttggtatggccttaggaggagttgttccgggtctggttcttgataagtttggatatgtggcaaatcaggcacaaaccccggcggcattaatggggattttaattacaacaaccattattcccgtgttcttgctggttctagctttaattgatattaatttctataacttagatgagaaaaaatataaaaacatggttcgagaattagagaatagagacaaagtttatttggaccatattgatgatttcaaggcttaaaaaagaaaataaactgaggaggagtcccaaatgaagattaccaatccagtactcaaaggattcaatcccgatccaagtatttgtagggcaggagaggattattatatcgctgtatctacatttgagtggtttccgggagtccagatacaccactcaaaagatttagtaaattggcacttagttgcacatccattacagagagtttcacaattagacatgaaaggaaatccaaattcaggtggggtttgggcaccatgtttaagctatagtgatgggaagttttggctgatctatacggatgttaaggtagtagatggcgcatggaaagattgtcacaattatttagttacttgtgaaacgattaatggtgattggggggagccgattacattaaatagctcggggtttgatgcttctttgttccatgatacggatggaaaaaaatatttattaaatatgttatgggatcaccgtattgatcggcactcatttggaggaattgttatacaggaatattctgataaagagcaaaaattaatcggtaaaccaaaagttatatttgaaggaactgatagaaaactgacagaagctccgcacctttatcatatcgggaactattattatttattaactgcagaaggaggaacacggtacgaacatgctgctacaattgcccgttctgcaaatattgagggaccatatgaagttcatcccgataatccaatcttaacgtcatggcatgacccaggaaatccattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttaaagcaacgtacccggaagttgatgaatttgaggattcaacattaaatataaattttcaaactttaaggattccattcacgaatgaattaggttcattgactcaagcgccaaatcatttacgattattcggtcatgaatcattaacttcgacatttactcaggcatttgtagccagacgctggcaaagtctccattttgaagcggaaactgctgttgagttttatccggaaaattttcaacaagccgctggattggtgaattattacaatacagagaactggacggctcttcaagtcacgcatgatgaagaactgggccgcattcttgaattaacaatatgtgacaacttttctttttcacagccattaaataataaaattgttattcctcgtgaagtaaagtatgtatatttaaaagtaaatattgaaaaggacaaatattattatttctattcttttaacaaagaagtttggcacaaaattgacattgcactggaatcgaaaaaattatcagatgattacatccgtgggggaggattcttcacaggggcctttgtagggatgcaatgccaagataccagcggtaatcatataccggccgactttagatattttcgttataaagaaaaataatttgcacatgaaaaaggagatttctattttagaactcctttttcatatgagaaggtgcctatatcaatattgcttcagaaatactcctagaataaaaaagctcatctttaaagatgagctgtacattccattaaaattacattgtaaccatgtccagaaaatgatcaatcacaatggaggacattcctaatgccggcgcattctgtcctaaggaagatggcaataattcatagctattgcctaaatgggaataaacccttgacgatacttcacttctcattgaatttaaaaccataggatgcgattcaattatgctatttcttaaaattacggcttgtgggttgaaagtatttagaatattggtaaggcctattcctaaatagaatccaaaattttgtaatgcatttaaggttccgatatcattcagatgggcgaggtttatgatatcttgataggacagttttttctctttagtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctatccctgtgctgatacttacgtaaataatgttatcgtgattttttgcagctccaaatactttctctccatatgcgccagcatttgcctcattttcaataaaaacaggcacattgtacttctcttgtatcgaagattttaagtcaatatctctccagttggagttcggagtgaaaacaattttttgatctttatcaacgagtccaggcacgcaaatacctataccaataagcccgtacggagattggggcatatgcgtcataaagtgatgaatcatatcaatcaaaatgtctttcgttatttctggagaattggattccaaatggcagtattgatcaagaacgatcgttccttcgaggtctgttaaaatgccattgatataatccacaccaacatctattcctacggagtatcctgcctttttattaaaaacaagcatgacaggtcttcttccgccacttgattgtccttgacctatttcaaataccagattttctttcattaacgtgtttacctgtgatgaaacagttgatttatttaatccagtcatttcagataattttgctcttgaaataggtgaatttttaaggatttcttttaataataacttttgatttacttttttgacaaaggtttgatcagcgatatccacttcatccactccatttgtttaatctttaaattaagtatgaacatagtacatagcgaatcttccctttattatatctaatgtgttcataaaaaactaaaaaaatattgaaaatactgatgaggttatataagatgaaaataagttagtttgtttaaacaacaaactaataggtaacttacaatatgaaataaaatgcatttgtatttgaatgatcatgttttgaatttatttttgagggggaaatcacatggctcaatctcattccagttcaattaactattttggaagcgtaaacaaagtggtttacgaagggaaagattcgactaatcctttagcatttaaatattataatcctcaagaagtaatcggcggaaaaacgatgaaagagcatttgcgattttctattgcctattggcatacatttactgctgatggtacagacgtttttggagcagctacgatgcaaagaccatgggatcactataaaggcatggatctagcgaagatgagagtagaagcagcatttgagatgtttgaaaaactagatgcaccattctttgcttttcatgacagggatattgcaccagaaggcagtacgctaaaagagacaaaccaaaatttagatatgatcgtgggcatgattaaagattacatgagaaatagcggcgttaaactattatggaataccgcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgataatttggctagatttatgcatatggcagtggattatgcgaaggaaatcgggtacacagggcagtttttgattgagccaaaaccaaaagagccgaccacccatcaatacgatacagatgcagcaacaaccattgcctttttgaagcaatatggcttagacaatcattttaaattaaatcttgaagccaatcatgccacattagctgggcatacattcgaacatgaattgcgcatggcaagagtatatggtctgcttggctctgttgacgcaaaccagggtcatcctcttttaggctgggatacggatgaatttccgacggatttatattctacgacattagcaatgtacgaaatcctgcaaaatggcggcctaggaagcggcggattaaactttgacgcgaaggtcagaagatcttcttttgagcctgatgatctaatatatgcccatattgcagggatggatgcatttgcaagaggattgaaagttgcccacaaattaatcgaagatcgtgtgtttgaagatgtgattcaacatcgttaccgcagctttactgaagggattggtcttgaaattatagaaggaagagctaatttccaaacacttgagcaatatgcgctaaatcataaattaattaaaaacgaatctggaagacaggagcaattaaaagcgatattgaaccaatacattttagaagtataacaggataagctccagatcctgctatcaataccaagtcactgaattacccgtcatgattcctttcctattgcttgttgttatgacgggtaacttctataattaggatttatttagagtgaatggttttttaaaagggcaaggagtgaaaaaatgaagtatgtcattggaatagatcttggaacgagtgctgttaaaaccattttagttaatcaaaacggcaaggtttgtgcagaaacgtccaaaaggtacccgctcatccaagaaaaggcgggatatagtgagcaaaatcctgaagactgggtgcagcaaacaattgaagcattggctgaattggtttctatatccaatgttcaagccaaggatattgacgggataagctattcgggacaaatgcatggattagtactgcttgataaagattgtcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggtgaaggaacatgaacctgaactttttaaaaaaactgctgtttttatgcttccgaaagactatgtgagattccgtatgagcggtgccattcacaccgaatactccgatgcagcaggaactttacttttacatattactcgcaaggagtggagcaatgatatttgcaatgaaattggtatttctgcagatatttgtcctccgcttgttgaatctcatgattgtgtaggatcactgcttccgcacgttgccgagaagaccggactattagaaaaaacaaaagtgtacgctgggggagcagataatgcttgcggcgctattggagcaggtatcctttcttccggaaaaactttatgcagtgttgggacctcaggggtcatactttcctacgaagaagaaaaagaaagagactttaaagggaaagtccacttttttaatcatggaaaaaaggattctttttatacgatgggcgtcacgctcgctgcaggttacagcttggactggtttaaaagaacgtttgcaccaaacgaatcgtttgagcaattattgcagggggtggaagctattccgataggagccaatggactgctatacactccttatttagttggtgaaagaacgccgcatgctgattcttctattcggggaagcttgatcggaatggatggagctcacaatagaaagcactttttgagggcaataatggaaggtatcacattctctttacatgaatcaattgagctattccgcgaagcgggaaaatcagttcatactgttgtttctattggtggaggagctaaaaatgataagtggctgcaaatgcaagctgatattttcaatgcgagggtgattaagttagaaaatgaacaagggccagctatgggagctgcaatgctggctgcatttggaagcggttggtttgaatcccttgaagaatgtgcagagcagttcattcgtgaggctgctgcattttatccaaaggcacaaaatgttcaaaaatataaaacactatttgatttgtataagaacatttacactcacacaaaggatctcaatacagctttgaagagctttcgaaaaaactaatgatgttattgtctggagatcaaccgacgaacaattaatgatcaatcatcatcaaaggcctttgatgacatggctgccttcttttgaaaagatggtgagaataaggtatcgcaacctttaaacagtattggagtgtccagcagacaaaacgaacgagcggaactgtattctgtcagcgaacacttcaagaagtgagaaagcttaggaatgccaatgggtaagatgtatgaaaccgcgctaacgacggtagagggatctcttgatttatgatgaaataggaaggatgtttacacacaaataaccccctcacattgacgtgaaggggtgttttttattgttactatacagcggaaattttacaggctagttgcatgattttagcttgataagcagaatggaaactagacacgccatcatctctttctcattctttggaaactgcattctgctaggtttgctgctttttttaacaaacagtgtttttctatttcacacagccattaaatcctctgtttgtcacataaccgctcttactccaaattgacagtttatctgattttgcttcttgctcatctagtctgaattggtctatgtattttgtgttaggctcatatacatatgctactctggccaatccctctttcaataatgtctcttgaacagatttgccgtcaacataaacatatgctaacagtcttccatacttatctctgcgatcgcctttatcaaattccagctgtagcttaccgctgttgaccaattctttatttcgtttcgacgcatcctcaccgtatggttgaacacaagaatttggtttcttcgtctcaggtgtatcaacgagcaagtagcgaactgtgtctttctttccgttgtaaataaccttaatcgtatctccatctattgctctatctaatgtaacattgaccaatttcttctgcttttttgaatgaggcgtgccggccttttgttctgtctgattatattcattagattgagtatcttgagagacttgctccgtcccattagaatctgaatggtttttggctgcgtgatgtgatccgcaagctgccaaagtaatacttaaaacgattgcgatcatactgatcaaaatcttcttcatattgattccctctttatcattttctcttttcgcgattaaacatcatcattataacgatatggacattttttgtgaatggaaaacttcaagggaacttataacactcaaattgccaatagttaacttcacaacgagatgatcaaaacatcaccatcacatagcggaaataaataatcctgaaaataatattgattgaaaatgcttttggaattatgataatatgagaaatgacaataatgtgacaaaaatattactacaacataacaactaatagcttaggtttattctactgtctaaaaatgtaaacggttacaaatccagaggcgaaaatctaagatagagatgactttagttttgactcaatatccacactgaaagagcttattaagtattcttaataaaggcaggggaaatggatatgaatgaacatcgaaatcgaaggttgaaattaataatgatttcagcaacttttggagggcttctctttggatatgacaccggagttataaatggagctttaccttttatggcaaggccagatcagcttgatttaacaccggttacagaagggcttgttacgagtattcttttattaggtgccgcatttggagcgttgttatgcggaagattggctgatcgatatggccgacgtaaaatgatccttaatctttcctttttatttttcctggcatcactgggaacagcgttagcacctaatgttttcatcatggcggcctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgctagtcatttgtgctgttccggctatcatgttatttgccagtatgcttaaggtcccagaaagcccgcgatggctaatctccaaaggcaaaaacagtgaggcgctgcgagttcttaaacaaattcgagaagataaacgtgcagaagctgaatgtagagaaattcaagaagcggtagaaaaagatacaacactagaaaaggcatcactcaaggacttttctacaccatggctgcgccgtcttttatggattggaatcggtgttgccatagtgaatcaaattacaggtgtgaactcgattatgtattatggcacacaaatccttaaagaatctggttttggtacaaaagcggctttaattgctaatattggaaatgggctgatatcagttattgcagttatatttgggatttggctggtaggaaaagtaagacggcgtccaatattattgattggtttggcggggacgactacagcgctcctattgattgcgattttctcaattgtgcttgatggatctatggcacttccttatgtagtgctttctttgaccgttttatttcttgcctttatgcaagggtgtgtaggacctgtgacttggcttgtcatagcggaaatcttccctcaaaggttaagagggcttggttctgggataagtgtttttttcctttggatattaaactttgtgatcggttttgctttcccgatcttgcttagctctgtaggtttgtcttttacattctttatatttgtggctttaggtgtattggcaatcggttttgtatacaaattcatgccggaaacaaaggggcgtacacttgaagagttagaagagcattttcgttctcgacacgatcataatactcctgaacaatcagttattgaggtataaatatgttgaaaatctctcttcttataggagggatttttttagtttcagaaaaaacaaaatccccctggtagagggatcttgattcagcattttaagatgttctacacgtataatactggagttgatactttaaaaatctcgccatctcttatataaaaacgagggatgcggcggcttaatgtagacacgacttcatagttaatcgtattgagcatttcagccacttcatcaacggaaatctcggctcctttttgcttaccgtaaatcacgacttcttctccttgtttaccttcaccgttttctcctaaactgaccatgatcatatccattgttactcttcccgccactggcactcgttttccgcgatgaagaacaaacccgcgattggaaagagcacgagaatagccgtcagcatagccaatcgggagtgtagcaattacttcattaggttctgcgatgtatgtagcaccatagctaacggttcggggttctgtccgcatggttttcacataagcgatgcgtgcctttaaacttaacgcaggttcaagcttaacgagatttagttgtttaatataggctgaaggatataaaccatacaagccgatacctaaacggatcatatcagcgctaaattccggaaatgcgatagctgcagcagtgttgcacatatgcacggtgggcagctcaatcccctgtttttttaaaaagctgagaaaactgatgaatttttcgtgctgcagctttgtgagtgttgtgtccggttcatcagctgtcgaaaaatgtgtgaaaatccctgtccatctgaggaatttacttgcctttaaggctttcactacttctaaaagttcttcctttgtgcgtacacctaatcgtcccatgccggtatccgcgttaatatgaatggccagccggttagcactcgcttctttttccaatatctcgtttgcttctttcatccaatcaacctggaatgctgataatgttatattccaagctgctgacttctttacacaactaagggatgtaaaaccaagcacaaggataggtgctgtaatcccagcttttcgtaaaacgattccttcctccacactggcaacagcgagctcactcgccccgtgttccagtgcatggcgtgccacttcgatagacccgtgaccataaccgttcgcttttacgacagccataattttgctcttatgtggaatatgacggcggatcgctcgcaaattctttttaacggcatcaagattgacttcgatccaaacttctcggcaaagctttatcatcaacgcttccttccttcttatggattataaataccacctattgccgcaagtaaatgttaattgttggatgattcgatcttattttattcaactttatttgaaatcattcaacagcaaatccatgtgatacgagaaggtgcctatcaatgttcgaataatagcaagtacgggatacatgaggcttgtaagtggggtgttaatgggtacggcgaccgaggattacaaaaatgattatttgtttcgggacatttttttctaagggtagatgataacgagaaatctaatcaggaaaaacttaccgttcatcaatacaaaggatacaggttagaattagtgatgtttgcagtatagaagcacagaaaaaagcaaggaagtaacagcaagcttccttgctccattgtattcctattagagagcacgcacttttgcaaaagcttttatcttagctccatcatcattttgacagcgaatataatatgttccggttttatagtgtgatacgtcaagagttagagttacacttttgccaggtttaactgtatagccggaagcgattgttccaccacctggttttacaattttgaattcaaatggattgcttcctgtattctcaacaaaaactctgatttcgccatcttcacttccataataatcaaaataaaattttccgtcacctctaaacgtttcttcctcttccagtataatatcggattgtgcggctgcaaacgcagaggcttttttaggtgtgtggtcaattgatgcagctgaagcataagtagagcttaatcctgtaattgaactaactaaaatcgaacctaccacaattttcttaaacacttttcttcatctcctatataagaaataaattacaaatttatacattcggtaaagagttggaaagacctttgggaaatcctataattcacaagaaatacaaaaagggtatgtttatttctggtgaatatttatgacggagtaaacatgtcataatatgaggatgattaaagcgtaatcaagtacggtctgagacaagcaggacactacatatgaaggcactgactggctaacttttctcgacaaagacaagagaacaagagggcgtctattgttatgaacattggaagaaccttttaaatgagaagggctgaggaaattctgtaaaagataatcggttgaaaaggcagtcgattccttgttccataaacctaacatcagagtatataattaaactcgtattcacaaaaatcgtttaagtaaggggtatacatgaataggggagttagttttcaaataccgaatgaatatggaaattttctatggagaatactgcagccggtagaaatagctaattataggtggcaaacgagtggggaatcttattttgttgtagaaggagagctcgataatgaggagctttttcatgactatgcaattgttgaaggggcagtttttgagcaacaattaaaaacgaatcagtactataccattttcgttgaactgaaagcatttccatatggaaaaatggttaatcaagtcaatatatatgaagagtttgctgacagtgattgcgaacttgtccttttgatagcagataatagctacgtttcgatttactgtaaaaacaaaaaaatcattgaaaaactgtacttcaatgctttacagaatgattttgaagacgttcaatttataactgatgaaaatgacacaagaacaagccttactgtatgatagtcaataaaaattaaaggagctagtacatgacaatgcaaattaaaatcaagtatctagatgaaacacaaacaagaatcagcaaaattgagcagggagactggattgatcttcgggcagctgaagatgtaacaatcaaaaaagatgaatttaagcttgtcccattaggtgttgcaatggagctgcctgaaggttacgaagcacatgtcgtccctcgttcaagtacatacaagaactttggcgttattcaaacaaattcaatgggtgttatcgatgagtcatataagggagacaacgatttctggttctttcctgcttatgcattgcgtgatactgaaattaagaagggtgatcgtatctgccagtttagaatcatgaagaaaatgccggcggttgaattggttgaagtcgagcatttgggaaacgaggatagaggaggactcggttcaacaggtacgaagtaaacaaaataaatccttggctgtcttcatgctgtgtgattgatcaatggaggtttcagccaaggtacatataaatattatgtataaaatgaatattttaatacgaaggatttaattaaaaacaaattttaaaaagggaagttttgaaaaagtgaaatagtaataactaaagtcgataaagaacctaaagatgtcaaagaaacaatttttctggtgctttgcttttttgaaggtttacttagctcgtggataactgcccccataaaagcatggatgctaaaattataatacttatatacatatagatgctccttttattatatttacagtttttacatttttattgattttaccactttaggattgagttgtcgatgaaacaagcatctctataaagaaatacttttatctaaatttttataaataggggaaggcaactaaaaactagtaatgccactaataataagccaagttaaatgacttgtgttcattaataattgaattttacagcagccatgagcacaaaaaaatctgagttcgtcgataaatatcataaaaaagcccccggtatgtcgccagggaataaatagacgtttaagagatttagtgatgttttttatatgattcgacaaaatcataataatgatcatcgtcatcataatactttttttcgtaatgataatcgtgatcatcgtaatattttttatcatggtcatcatactttttgtcgtaatcataatgttttttatcatgatcataatacttgtcgcaatcataatgcttcttatcattgtcgtaatactttttgtaatatgtttttttccaagtgtaatactcttctttatattttttataataacccaattaaattcctcctttatgttattcgaatttaatttatgaagtttaaatgatatggtatggtcaaatgaaataagaatagtaaaaagaggctgtttaaaacactttctgaaaaacaaaacggatagctgtttatgaaaataagagcgagagagagcactcaatcactgtaaaataatagtaaagtgtatagagaagattaatatacgtaaaaagggactttctcattgaagaatatttgaacgttatggtcaagattcaagagctctatgatatgatttttaatactgcttttgaaggatttagagttagacatcaaaaacaaacagcaaaaccggttagaaacagatcatataaggaatgaaccgctgccaaatatcataaaaaagttgttaatgatcaaatgaatgaaattagagagaatttattttaaagaaagcccaattgcacatggacaaatgacaattgatattcaggtaaaatacaatgcattaaatcagaaaaagctattggaggatttaatgtgtttagacaatttccaatttggtatacacaaacacctaactatttgaatttttatgtgccgcaatatcaaaccatttcttataatcctcaacaatgttatcaacggtgtatgtaccaaactggcggtaactatgagctatgtgacagactatgttatggagaaatacaggtgtaaaagagggggattaactcctctttaaacacacagtgagtggaataagatcctcactttatctgcaagtgcttagtatttgcgataatattgcattcgtaataaattatgcttagcaactgaaaatgaaagaaggatatgaatagtcatgacgcaattcgataaacaatacaattcaattataaaggatattatcaataatggaatctcagacgaagagtttgatgtaagaaccaagtgggactcagatggaacaccggcacatactctaagtgtaatcagtaagcaaatgagattcgacaactcagaggttccgattttaacgacaaaaaaggttgcctggaaaacagccattaaagagttgctctggatttggcagctgaaatctaatgatgttaatgatttaaacaagatgagcgtacatatttgggatcaatggaaacaagaagacggcaccatcggacatgcatatggatttcagttggggaagaaaaacagaagtctaaatggagaaaaagtggatcaggtagactatcttcttcatcaattgaagaacaatccatcttcacgcagacatattacaatgctgtggaatcctgatgaattagacgcaatggccttaacgccatgtgtatacgagacacaatggtacgttaaacatgggaaactccaccttgaggtaagagcacggagcaatgatatggcattgggaaatccattcaatgtattccagtataatgtgttgcagcgcatgattgctcaagtgactggttatgagcttggtgaatatatctttaacattggggattgccatgtgtacacacgtcatatagacaatttgaaaattcaaatggaaagagaacagtttgaagcacctgaactatggatcaatcctgaagtgaaagatttttatgactttaccattgatgatttcaagttaatcaactataaacatggggacaagcttttatttgaggtagcggtttaatgctgcctttttattgtgcagtgaatagatagcaggtatcctaatttcattaagcaatctggaagatgaataaaaattgaaggacaaacacgtataatacataaaaaagattaactctacagttaatcttttttattcagaagaaaatatcctaactttgaaactaaatacaaagtaaaagcaatcattacagttctagatattacaattccatgaatagctagatcatatccagcaggtatcaacgcatttgtattacacataaaatatatagatattagaagtgctacaataactaaaatcattccaaaaagacttgttttttcatatttcataccaatttccacccttattaaagttaggtttaaacaaaagagctgaagaaacgaactatgaccagtatgctccaaggaaaaccgccagacaatgctggcggctttttgctgcttcgtttatttattaacagagatcgtaacgttatttcctgcaactgaaacctttgcgaaatcctgtgtatctaccacaggagtaacggctttattgtcgatagtgatgttgttaaaagaggtcgaaaaggttgctttgatcgcatcacgctggctttcatacgaaacagccgcggtagcaagggttttccattttgaaatcgtgccgatgttggttccttgaatttctgtgataatccgtccagtatagccgtcattgttcgttccccaaagggtcatgcgcgtattgccgcttaaatttttatagattgtcatttggactgtgcttccagggcggaagcctttattgtatgtgaatttgtcttttccttcgatgtacgtttcttcatttttggacccaaccttcatgaggggcttccagacgttgtattgtttgctgtactgaagcccgatatcggcctcagttccgcttgttgccctaaatcctgaataaatataaggagtagagaccgtatcatattttacagtgtcaggaagattgattttagctgtaaaaacggcgcctgtactattcagataggcgcggccgccgattcccttaggcagctgtgatgctgcttttgcgacttgagcatctgccgcgggcaagcctggtatacctgatggaagtgttccgaaaagaatggctgttcctactgcacttgcaatcaatattttttcactcaaattcccccttttgatagtgatttcgtcatttattataccttattttggaactggattgatgtatataaataaacaaaatatttcattttgagtgatgtaagggacgaaacgcttctccaatctgaaagctatgtaactttatcagaggaaagaacgagatcacaatcgttttaaccgatttgaaattttccccaaaataaaagtacaaatgcttaaagaaacgatcattaaaagaatgcccgctatcgtttcccagcctgtaaaaaagaggtgacgtttcatcaatgtctgtccttgtaaaatgataaaagcacagataccgactaagaaaagaaaacaaatacttaggattgctaacgctttacgtgagtatgttttcatttcatctttaaaatacagcaatacgaaaacaaagcagataacattggctattgttcttatcacctcaaatcttttcatgacaactgatataaaaagacaaagtaaaatgagataaaatacgatgtttctatacaaaaaacctctccttttatgtatgatcctcaaagagtttataaaagtttctttgtaactgcaataaactgaatgcgctcatttatgaactaactaaactatgtactaaatattcattattcttttttagattcagtcaccaaggttttcatagaaagggaagcttcagaaatatacatatagtgcataaacaaaaaagacccggcaatagccgggggaaagtaaaaacgaggagatgtgaatggcgtttagtagtgttttttatgctttttatactctacaacataatcatagtcttttttatcgtgatcataatattttttatcataatcatcatattttttgtcgtaatcacagtcataatattttttatcatattcgtaatacttcttataatacgtttttttgaccgtataatactcttctttgtattttttgtaataacccatatttactcctcctttatttttactacgctttattatacggcgagtagattttgcggcttggacagttaaaatcatagaaggaaaaaagggctgtccaaatgataaaaaaaaggcagatgacacagaaacaaatcaaaataaagagccgatttttcatcggcccaaacgatttatcctatatttgtttgtcttctttgttttctgagtcactttttctgatatcctgagtcagtccgcttgttgcttgtttaaattctgataaggcttttcctgctgcacggccaagcgctggcagtttatcaggtccaaatactaaaaaacctacaaacaaaataacgagtatttttgtgaagcttaattccatatccttttccccctgattgaagtacaaccttttaaacaaattataagagatagcagtacaaatgggaatgcatttatttttaacattttaaaaccagcacaaagacggattcataaaacggctgctgctgaatataatgtccaatgccacctgcctaagaagcagggaggcaggatggatcaattatgtagctctgccggaaatgatacaaacgtatctgcggctatcattgaaatagaggagtggtgtagctgatgagattcactaaggtagttggatttttgtctgttttagggttggctgtggtttttccattaacggtacaagcagaaaaagctggaactgctggggctggagagtgggataagttggggacttacacatatacttactcaagtccgacggtatactcaaccggaggagattttagagtgtgcctttcaggaagcactcctttttctgtctcactgcacttatatgaggatgatcccggtgacaatcctgatgattatgtaggggcaaactatttttcacccggagaatgccacacatttggcagtattggaaaatttgtagatgggagcaataacaaggccgagttctatgttaccgattactctggtaaatctaaaactgttacgttttatgattgatggactcaaattgtgaagtataacccttgggaaagaacaaaaaagagagatacctctctcttttttatgcttcgacagccttacgaagcctttcatttacaatgccagtccagccgccatccatcttgccgcgaacgacggagcttttctcgtttgctttgccgatcacttcattcggctctttccagccgctgtgaataagggtaaaccctgtcttttcccccaagtcttctaattgaaaggtaacgacccatccttctgtatcccattcaaaagaaagttcagttggagcttgaacagccaaaactttacaaggggacggcccaaacggtgattgtaagtgaaattcttgtccttctttgagctgaaagtcattgggcataaaccacttggcaatgccttccgaagtagagactgtctcccagactttctgaatgggagcctccagggtaatgctttttgtaatatccggtaatgcattttcgttgttttgagccatttcgtttacctcttgacatatgatgtttttttcaattcaatcatataataactaataagatcatgtccatagcgtgcattatttatgctagagctgctgttgaacagcgtgtcagtcgccagtctgatctgtgaatgggagaattctgcatgcgcgaaaaagagagaggtgtatgttgtcatttcgttcattcttgtttgctcgccgcaactgctatgtttgaaccggaattcctgttcaggcaatttattttgcgatttttgttttaatagtaaatgtgccattttctaaaacaggaggttttttatgcttggaaaaatcaaagcagccattgataacagtccagggaagccggccagaattatagttagtgaaaaagtgtttcagcaattagaggaagaaatgcgctttgtttacgtatccaaaccgaaaacgataatggggattcctgtggaagtttcagatcaggcagaaagcttcaagctggaattttagtttatcccagactgctaaaaggctcattttgtgtttaataatgcaaaatggtcaggttgatttctttaaaagcatgatgaaatgttcatcatgctttttttattgagaaaaaagacgaacataaaaaataggtatacgggaaaaataatcctattagagagaggggaactgacagatggataacatgatatcaacacttactgactggaatgtgtggtttcaagcgttagtagtatttctcgttccatatgcaatctataaagtgtttacttggattcatgtataagaaggtgcaatgatgaggtggcggagcaatcagtacaaaacacagaagcagcataaatcagatcattcaacagctgaaaaggatcaggatgtgttaaccggtaacatcggatacgatttagaacatgtaaaaagaaaaataggacataacggggacgttcacttccgtgagcttgaaatcactcatttacatgtgaaagcggcattgatctttgttgaaggactgtctgatcaggatttgattaataaaggattatcagtgttattcatgaatcaacctaatcaggtaagcgatgaaatttctcaatccggcaaaggtattttaacttcgaaacagataaaaaatcaaatcatatcaatcggtgatgtcatagaatcagagaaaatcagtgatatcgtgttgaatgttttcatgggttcgacagcgcttctcatcgatggaataccgcaggcctttcttctgggaactgtaaaaaaacaaaatcgaagtatcgaggagccgctttcagaagcgcttgtcagagggccgcgcacaggctttacagaagagttgagtacgaatacagctcttttgagacagcaaggaaaaaatgatcaattaacattgcagagatttgaagtaggaacacgattaaaaaaggatttaattatcgcttatatgaatgacattgcagatccaaaagtagtcgaggaagtaagaaaaagagtgagagggattgagatcgatcatttgccggagtcaggctacgttgaacagttaattgaggataattatttgagcccgttcccgcaagtacagagtacagaacgtcctgatcgcgtcataagcggattaatggaaggaagagtagccattctgcttgacggcactccgtttgctttgattgttccagtcactttcagcatgatgcttcaatcgcctgaagattattatgaacggtggttcccgagctcgctcatcagattgctgaggttcatcgcagcaatgataacgttattcgcacccgctttatatatatcatttatttcttttcatccggggttaattccgaccaagctggcgatttcaatttccgggacgcgccagggtgttccgttcccatccctcattgaagccttatttatggaagtcgcgatcgaaattttaagagaagcggggcttcgtctgccaaaaccgattggacccgcaattggcatagttggcggattaatcatcggggaagcagctgtgcaggcggggattgtcagtccaatcatggtcattgttgttgcgctcacagcaatttcttcatttgccatcccgcattatagcacaggtatagcacttcggatgcttcggtttggcgcgatgttttgtgcggcggtgtttggattgtttggagtcattatgtattatctgctgctaagcagccatgtcgtaaagctaaagagctttggtgtgccatacgcaagtccggcagtgccctatcacttaaaagattggaaagactttgttatcagaatgcctcttttagtcatgaagcgccggcctaaaatgatgaatacagataatacaaaacgggtgaagtgatgaactcgacaggatggtgataaagtctcatgttcagcccaaccagtaaaatcacaaccgctcaggcaacgattatcatcattaattatatgcttgctgccggagttcttacgctccctcggacagtaacagaacaaacacaatctcctgatggatggatttcaattttattaggcggggtcctagcggtaatagccgggatgattatagttaaattaagccagcagtatcctaaggagaccttttatgaatactcccgacatattgtaggaaaatggctcgggcatctgatcagtattgtttttattgcttattttctggcactcggtgcatttgaagtcagagtcatgtccgaaatcgtggatttttttctcctcgaagggacaccgtcttgggccatcattatgacagttctttggattgggctttattcaattacacaaggcctagatccgattgcacggctttttgaaatgatttttccgattacggtcatcatctttttaacgatagccctcatgagtttaggcatatttgaaatcaacaatttgcgccctgtattaggagatggaatcatgccggttctcagaggagtaaagacaacgaacctttcatttacatgttcagaaattatgctcattttagtagcatttatgaaaaagccgaaaaatgctctgaaagcggttgtgattgggacaggcgttgtgaccagtttttatatgattacgctgattatggtcatcggtgcactatcagttgagggagttgtgacgagaacatggccggggcttgatctgatgagaagttttgaaatacctggtttaatatttgaacggtttgaatcatttctgcttgtgatttggattatgcagctttttgccacgtttattatcactttttatgcagcttccctgggagtctcacaggtttttaaaaagaaacccctttcatgtatgtttgggctgcttcctgttatttatatcctctcttgcatgccgaaaaatgaaaatgacgtctttatattgggcgatacggtcagtcatatcgctttgtatatatttggcgctttgccgattttgctgttagtcatttcgaaatggaggaaaagaggtgaaaagtaaactaaaacgtcaagtgcctgctatggtcatagtatgtctggtgatggtttgcgtaacaggatgctggagcagccgggaaatagaagatctgggtctcacattcgctatcgcaattgataaaggaaaagaaacgaacactgaaaaagagttaaaagaagagggcgggagctatccgaaaaaagacaacattacgctgacctatcaatttgttaatgaaaaagcggcaggcgcgggcactggcgggggaggcggtagcggacaaggagtgcaaaaagcgtatattaatataagtgaaacaggggattcattacagcagatcggaagtgaggttgcactaagacgggaccgagaagtgtttagcccgcatttaaaagttgttgtcatgagtgaagatgtgctgcacacatttcctatcgacgaaatgctggatcaattttttcgtgataatgaaatcaggctaagctgtcttgttttatctgctaaaggggaagcaaaagaagctctccagctgaaagagaacggagaaattccggcttttcgactgattggattaggtgaaaatgaacataaggtttccaaaattcttccccctgtgacactcgcgaaactaattggaaaactgcattctggcagcagctttttactgcaaaatgtggttgcggcgaatggagcggtcaagtattccggagcagctgtaatcaacggaaaatcgaaaaaaatgataggcactttaaatgaatatgaaactgaggggattacatggattagaggagaagggaaaggcggagttgtcaaaagtcatgataaaaagagccaacagacgttagcgtacgatatcaataaaatcaaaagcaaaattcagccaatcgtaaaagggacggatatttcattccatgtcgatattgaatcagaaggcgatttggttgaaaactggaacacaaaagaggcgttggacacccagtttatagatcgtctcgaaacgactattgaaaacgaggtaaagataatagttggtcaggtattaaaaaaaattcagcatgattataaagcagatgttgcgggttttgatgaatcttttagacttacatatcctcacttatggaaaagggtgaaaaataactgggatgacaccttcagtaaagccgacatcacatacagtgtgaacgtcacaattactcatttcggcacggttaaaactcagtaatgaatcccaaggaagagaaggaaacctctcttctcttttttatgcattttttaggataaagatacattttttggagagatatacacttttcaaatcgaccaatatgctaatataggaattgcttgaaatagaagggagaaggggctgtgaggcagaaaccgatttatgtagaaatcgaaatgaaatctgatctggatacactctgggaatatacacaaaacccatcactgcataaggaatgggatctccggttttcaaatattacgtatttgaatagtcagccatgcgaaaaacagaagtttctttacgaaacaagggtaggctttggattaaaggtgtcaggtacaggagaaaccgtcggtgttttcaacaaatgttcatctgaaaggtcttcttcactggcttttggctctaatcatccgttatctctgattcggcatggaagcggctactggaagtatatacagagagaaaatgggaaaatgacgtttttaacacagtatcaatacaaaacagcctacggactgccgggaagatggatcgatcgtttattatttcggccgctgcttggctgggcgactgcctggagctttgatgcattaaggctttgggttgagcaaaataaacatccgaagcgcttcattcgatctgctatcatctatgtgttcatgtgtctgtttttcagcctgttttggttctatcaaggctttgcaagtgttgagacaagcatattggcaggaacagcggagataggcttagctattttgtggctgattcctttaaaaagaaaatggatcattcatggtgtccaggcttgtatctttgcggggtttgcttgtctaggttccgaaatattcatgtgggttctgttgagtgtgttttccgcagcaagcggcgctcttagcctgcagctccccagtgccaggcgcacaaaacgaaagagaaagaagtgacattgtgagttcgatttatgaaaaatcaattattaactatcatttgctgcatcccaagctgcggaaacggtaccaattagacgggtctcaaacattcagcgggacgggaacgatgtcagaaataagcggaggctcttttctggttagaatgctgttaaagctgggtgtttttttcagatgcttcttttcagaaagaggcaaagacattccatttacaatacaaaatagaacttgtcttttgaaatcgcaacatacaggaatagaatggaatcgtacatttttctttaaaggcaaaaaacgtttctttgacgcgataatgatatatgacgagaaagaaaatagaatacttgatttcttcggcaaacctcatctgctgctgtctgttttgacgttcgaggcatctcatgacggctctcttacgatcacatcgggaaagcaatggctattgatatgcggaaaaagaatcccgctgccgaaatggctgaccggtacatccgaagtttgcgaaacgtttgatgaaaaaaagaattgtttcaccattgaagtgcatgtgcaaaatacaattcttggcactcttttcttttataaaggaacgtttcaggagaaagagagagaatcatgaaacgaaatggcatagtcagtgcgctttgttttataggatttcttgcagcggaagcaccggatatttcagtggcagaggcactcgttttgttatccattctatttttcgtgccgggaatttttccttttgtttttcgtcaatctccggttcgtgctgctcagtttatggaatatgggctaatccagtgctaccctgtagccgcattctttgcagtgttggctcttgtgacggaggttgggggtttcgcacttatctggtggatgtacacagtttttattgcattgtatgcgatcttccgcctttgggaaacaaagatacatagaatcgaagagacatcagttttgttcggtcttatttatttggcgggaggaggattttggttttttgcttatgctgcccatttgcagatcatgcaatttggccctctcatcattttgctgactgctgtccactttcactattctgcttttctgatcccgatcttcaacggcttactcggcagaaccattagaaaacatcggatgttgtatagttggataacatgggtgattttgctttcgccccttcttatcgcactgggcatcacatattcaaaaacacttgatgtcattgcggttagcatttatatggcggcgatttatcttcatgcatttttggtgttcacggcagcttttcgcaccaagacggggacatttcttattcggctttcttccgctgttttaatgataacgattgctttctcgatgatttattcatttggtgtatttcggcaagaagttacattgaccatcaatcagatgatttggattcacggttttgtcaacgcgtttggtgttatcttgcccgctctcatagggtggagaatagaggatccgaagccttttgatgcagacagtgtaaagacattcagccgtatctacggaaaaagaaagatgggagaagaatttttagctaacattcaagctgaaaataacgctcggtacagcggacttgtggatgatatgggcagcctgcgttcaaaagatttttcaccagaaaaactggcgccgctcattctttcgttttatgaacaaaccatcgaatataatattaaagcaaaagtaacatggagcacgtggtttcggccgcttgcaattatttacgaatggttcagcagaagaatcggccaaatacatctttcgacgtaccctgactggtacaggatgtacagcaagataaaaggtgttcattctaaaaaagacggaagggaaagagtacgtgcctggattagaacaaatgaaaaaaacgaaaccatttttaccgctctttattcagtgtatcgttcaaatggagaagggtatatgaatatttctttaccgcttccattcagcagcatgacaggtattttaaaaccatatcatcatcaggagaagctggttttaacaagcaggcggagaaaaagcagagcgggggatgaggggatttatctgcaaacaagagcgggaacttgtccgcttcctttatctgaaacctttctgatagaagctgtacatgacaacaaattaaccgctgttcatcatatgtggctgtttggaataaaatttctaactgttcattacagcattacacatattaaccagcctattgaaagaacctaacacaaagaagaagcttcgtctgccagttgtaatgagatgaactgttttaaaattctgcaccgcataaagacaggaaaggaagggtttatggtgttttatatcagtttatttctgattctttggctggctgctgggtttgcagtgggaatgaaacaagtgtatgtcgatcagctgtttgataaagctgtgatcgaaagactggaaaaagaagcgaatgatcatggacatgctgaccggatgatcaaacagcgcgtcctttatattgcagcagtgacagtaagcgggtttatttctgtttattatgaaatgaaaacaatcccgcaaaggcgaaacataagaaaaattgaaaaaaacatcatgaaattaaatcaagcaaaaaaacgaagaatgaagaaaaaataaaaagtgcacaggccaaagggcaggtgcatttttgttttgtatggaaaatgggggaggtggtgccagcttacttttcataaattcaaaaatgagaagaacagcgcccgggctaatggtatataatattgtgaatttaacaaaaatttaacaaggaggacgagagaattcgtgctaaagcctcaaagagacctacattctgttgatttggacttagaggcggagtagatgaaaccggccaaagtatccctgctccgccgtttgctccattccttgaagcatgttgattgtaacatagccaaacgttttccatcaactattaaaattgtaaaattattgttgatttttatggtgtttactccgatttcttcaatttatgctgaagatgtatatcagaattttgaggaattaaaaaacaatgaagatccttctgattacggcgttgttacgaaagaaaccggaagctctgttcttgttttagctattcacggaggaggtattgaaggcgggacaagtgaagtagcgagagagctcagcaaagagtactcgatgtatttatttgaaggcttaaaatcgacaggaaactcagtcctgcacattacgagcacacactttgatgaacctcgggcccttaaaatgacgggaaatcatgaatatgtcatttcattacacgggtacgcagaagaagatcagcagatcgaagtcggcggtacagatcgcgtaagagcggcagatttagttgagaaattgcagcatgccggttttcctgctgtattgctcaatatggaccatccgcatgcgggcgttagtccgaataacattgcaaataaatcaaaaacaggtttaagtattcagatagaaatgagcacagggtttcgaaagtctttgttcggcatcttttctttaaaaagcagagctgttactcaaaatgagaggttttatgagtttacagaagtgatgttccgttttctcaaaaatagctactgaaaaataggaggcgataagacagcctcctattccttatgcttctctttcgtttcgggaaacagctcgtccgcggcttccgtttgatactgcaacgtgttatctctcgctgacagttcatttcggaaattttcatcaagcacatttttcagtaaataccgatgaaaaaagtattcaaaaacagtaagacaggcagcggaaaggagagctgctccaaatggtgagaaatcgtttcttgtttgggttaaaacaaatacccaaagaataacgaatgaaaggccaaagtcagctaatgaagctgtaatattgtttgttctgggtaagacgagcatgtcaccagaaagataggaaacaaaacctaagaaaagtgcaataaacatcacacttaaaaaggatgcgtgatagactctgtccaaaatcacatataaaagggcgagagtgaaagcaatctttgaagcaagcgcaatgatatgtttcatttgaccacctaaattgttattttttgaagaaaattcttgggcgtaaacaaacgataaataatgcaattcaaaaccattcataatggtcatgttactattttaaacagtccgtttttgtttacactggtattttttttcagctgtatgaaactttcttatgaaaaagtcgtatatgtggatgatcagctttcaagggggaatgatttgtggagataaaaggaatcaatcacttgctattttcagtttcgcatttggatacatcgattgatttttatcaaaaagtgtttggtgcaaagcttttggtaaagggaagaacaactgcatattttgacatgaacggcatctggctagctcttaatgaagaaccagacatcccgagaaatgacattaagctttcttatacccatattgcttttacaattgaagatcatgaatttgaggagatgtcagctaaattaaaaagacttcatgtcaatattctgcctggcagagaacgagatgaacgcgatcgaaaatcaatttattttaccgaccctgacggccacaaatttgaatttcataccggaacccttcaagacaggcttcgatattacaaacaagaaaaaacgcatatgcacttttatgatgaaacggccttttgatagcacaaccatatttcatataaggttaaatttaaagaagggtgttggtggagactttatgtttggggaaggtttctacccgacttgttcaacgatgccatatattttgaactgtacaagtgattgggtgaaggtgaaattgaaatacacattacattttatatgaagaaagcgagctgttttatcagaatgttgaactaattaaactatgtactaaattttcagtatatttcaattgcttcgccccttaataaatatgaaaccgtatccttccacgacctaaaaaatgaaacgtttttaagaagatggcgtctaatattctaaatgttcatattttgataaaagtttcctaaaggaaagaaaatttcttgacttcaacaatcttttggtggataattatggtgtaaacatgatgttctttttcctcctattcgggctcgcacccaaaagtcagggcgagcctgctttttttgaacaacaaaccccctctccgtaaaggaagagggggttattttatgcatctgatagatcaatagattaatggacggttctgaacacgccaatcactttccctagaatgctgacattctgcaaaatgataggttccatcgttgggttctcaggctgcaagcgaatgtgtgtatcctctttatagaatcgttttacagttgcttcatcatcttctgtcatcgcaactacaatttccccattgttcgctgtgttttgctgtttaacgatgacatagtccttatcgagaataccagcatctatcatactgtctcccataatctccagcataaatacatgctcgtctggaggaaccatgcggtcagggagcggaaaatattcttcaatattttctactgctgtaataggagatcccgccgtgactttcccgatgaccggtacattaacgacctggctttgcggaatgtctacttcttcatcaagaatttctattgctcttggttttgtcggatctcgtctgatcagcccttttgtttccaagcgggccaaatggccgtggacagtagaactggacgcaagcccgacagcctctccgatctctctcacggaaggcggatatccttttgatttaacctctgctttaataaaacggaggatatcaagttgcctttttgatagcttcgtcatttttcgcacctcaaaacgtcgattttaagaagattatagcatgattttccttacagtacaaacataggttcgaaaaaacaattgacagaaacgtttgttcgtatatactgaaattataaaaatgcgaacaaacattcctgttggaggttatgatcatgagtaaagaatctattatttttgtcggtctgttcacagtgattttgagcgcggttatctttatgctgtcatatacaagcagcggccaggagcttaatcagtatgttaaaatagaagtccagcaaggcgacacactttggtcaattgctgatcaggtagcagatacaaaaaagataaacaaaaatgattttattgaatgggtagctgataaaaatcaactacaaacatctgatatccagccgggtgatgagttagtgatcccattgaaaaagaagcatcaggatgcatatgaattggcaactgtaagatagagaggaaagagagataaaatgaaagcactcatttatgcccgtgtaagcacaaataaagaacagcaggaaacgtcattaaagcggcaggaagaggagcttacggccattgctgcggagaacggcatggaagtcgtcaaagtgatttcagaaaaagccagcggatatgaaatggatcgggatggtgtatttgagctgcttgatgagattaagatcgctggaattgatgtcattttggttcaagacgagacaaggctcgggcggggaaacgcaaaaatcgcactgcttcattgtatttacagagaaggtgtgaaagtctatacaacggctcatagaggtgaactggagttatcggaggctgactcaatggtcttggaaatcgtcagcattgtggaagagtatcagcgaaagattcacaacatgaaaatcagacggggaatgaagcgtgcagtaaaaaacggttttaaaccgcaaaaaaacttaaaaaaccaacatgagaacagtggaaaagaaaaaatagaggtgccaatctctgagatcgtccgcctaagagcgaataaactaacgtttgctgaaatcgcggctaccctaagagggtttggctatgatgtctctaaagcaaccgttcaccggcgttttcaggaatacatagagaaagaagagacagcagagtgaatcagttgtaaaactttttttgatctagtactatatagacaaaatgcaataaaggagtttaacatgatttcaaacgcgaaaattgccagaattaatgagcttgctgccaaagctaaagctggcgttattacagaagaagaaaaagccgaacagcaaaagctccgtcaagagtacttgaaaggttttcgttcttctatgaagaacacgttaaaaagcgtgaaaatcattgacccagaaggcaatgatgtaacaccagaaaagctaaaaagagaaaaaagaaatagcaaacttcactaatataagaggaatacggcaatatcgtattcctcttttgcatatactataatcaaaactcttatgtgacaaaattcaacaagtttctctcaaatttaagctgaaacagttgagaaaaagtcgtcagacatttatgatgtaagggtacaacacataaggaaggggatttttatggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacacctggacacccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaggcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcaccgcttggtaaagaggaaagcaaattaacaaaagaagcttacgcgtggacgtatgaagaagacttctacgttccgtcagaagtttatgagcatttcgctgcagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagcctggcatcccgtgcatcttccggtgaagttctcaacggacttgcgaaaaaagttcctttctttgtcggaggttctgctgacctagcgggatcgaacaaaacgacaattaaaaatgccggtgattttacagcggttgattactcaggcaaaaacttctggtttggtgtacgtgaatttgcgatgggtgcagccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggtaggtgaagacggtccgacgcacgagcctgttgaacagcttgcttcactccgtgcgatgcctaacctttctttgatccgtccagcagacggaaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacctgacgctcttctcatcgcttccggatcagaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctccaggtgaaaccatcattaacgaatacggcttctcagttccgaacgtagtgaatcgagttaaggcattaatcaataagtaagcttttgaaagaggatgagtcaaatcatcctctttttcttgtttatccgacaaaaatagtattggcggtttaacagtaatagacaattctttcttttcttcttttgtataatagagagcaaatgaaatgctgctggaaaaggggatgaaaagatggaacgtcactactatacgtacctgatcaaagaggaatttgccaatcactatttcggccgggaatcggttatgtttgagctgtttcaagactatcattggacaagccttgaaaagcagcagtatgaaatgacagagaaacagattcaatatattacacaaccaatcccgattttacatatgcatcagcggttaaaaatgaatttaaacaagacggattacaggcagctggattatatttatagaatagctttgccgaaagcaaaaggccacgcgacgtttatgatgaaggagcacatgatagaaattgtggcttcgggagattacgaggcagaaacgatattctttgaagtgttaagaaaagttagcccttgctttttagcaatggatttcaattcgaagcgttacggatggctaaatccggtgaaagaaagaaattttgtctaaaaccgaagaaaaagagatgtaaatgttgtataatagcttttggtttagtacactttaaactagacaacatgaaggaggaaataaaatgactttatgggttggcatcctagtgggcgttgttgcattgctcataggtgttgcactcgggttttttattgctcgtaaatatatgatgagctacctgaaaaagaatccgcctattaatgaacaaatgttacgcatgatgatgatgcaaatgggaatgaaaccttctcaaaagaaaatcaatcaaatgatgaaagccatgaataatcaaacgaaataatacgtaaagattatgatatagagaaacatggttataaaataaaaaacccttatacgggttttttattttgcaatcattcatcacccgctactgctcgaaggcgctgcttttgatattgtatgagaagatggtcaagctcctgactgagctctatcgtaatatgagatgtcattccgttcgccatgacaatttgcagcagctctgctctttttttttcaatttcttttaatagatgctctctaatcacagggatgtatcctttcatacattagatcttcaaagtgaatgtttatattatatccatatttatactaattttcaaatgagaaggagtataatgtctcaatgtcaaattaaattatataagttttttctgaaaatagaaatccttcaagtgaaagtgttaaaaaaatgaaatgattttgtcataacttgaaggaatgtcaaatcatgaagggatgatgacatgggagacgtgaattattttttgacattcggagcggggtttttatcctttatttcgccttgctgcctgccgctttacccagcttttttgtcatatattacaggggtcagcatggacgatgtaaaaacagaaaagctgctgctgcagaaaagaagcctgtttcatactttgtgttttttgcttggcttttcagtcatttttattgctttaggctatggaacatcttttattggcagcctgtttagggattatcatgatgcgattcggcaaattggcgcgttgcttattattttgttcggtttcattacactcggtgtgtttcggcctgaggctatgatgaaagagcggagaatccattttaagcataaaccaagcgggtttttagggtcggtcttaatcggaatggcatttgcagctggatggacaccatgtaccggtccgatattaggtgctgttatcacacttgcaggcaccaatccgggttcagcggtgccatacatgatgttatatgtactcggttttgcggtaccgtttcttttattgtctttttttatcacaaagctgaagtggataaggaagaaccagcttttcattatgaaagctggcggcgttttgatgattgtgattggtgtgctgttattctttaattggatgagcctgatcattattttgctgtcagatctttttggaggctttactggtttttgacggtaaattactttcgtactactactaatccttttgtttttggtacaataagactattatctgaggaaatcgattgttggaggggaatatgacaagagttttagttgtagacgacgccaagttcatgagagtgaaaatcagagagatcttggaagatgcaaattacataatcgcaggcgaagcggcggacggtgaacaagcagcggacctgtataaaaaactgcgaccggaccttgtgacaatggatattacaatgccggtgaaaaacggcataaaagcgcttcgtgatatcttaacctttgatcctaaagcgaaggtcatcatgtgcaccgccatgcgccagcaaagaattgtaacggaagcaattgagctgggggcaaaggattttattgttaagccgtttgaggaaacaaaagtgctggaagctgtaagccgcgttatgggacattaaagtcatttcttttcaaaatggttttttttattgttttggagtatagtatatagtatcaacactccgagaaacaaaggaatgataagtatgatgattatagtttcatcgattattgctatgttaatggctgtagctgtgatggtggtcagaataaagtcctctgacaagcctgtttcaccaaaaaaaatcattcttccgccgatttttatgagtacgggagcgttaatgtttttatttccggtattttgggtaactggtgcagagtttttggaagcattcactttaggtgtgattttctctatttttctaatcaaaacttctaagttcgaaattaaaaataatgaaatttacatgaaacgctctaaagcatttgtttttatattagtcggtcttttggtgatcagaatcgtgatgaaatccatcttgagcacatcaatcgattatggtgcactgagcggaatgttttggattctggctttcggtatgattgtgccttggagaatcgccatgtatttatcatatcgaaaacttcataacgagctgcagtcagctaatattcaaatgaattaaaaaacctttcctcttgtcaggaaaggttttttatttgagaagggtctgataaggttccaaatcgatttttttgtcccgcagatgcctttttaagaaggtatggtctcttttaggagttgcgagaatatagcctttgatcataagttgctgatcaatctttgctaccttttcttttaatgcaagctcaccgattttgcctgcgattttagcttttgctgcatctctgaacagttctggcaccggcgcagtcaattcatctagaaactgtttgttttcatcgttccataaatgtctgctgttttcaatatagtaatcctgccaatcaagctctgatctgccgtcctcttttggtaaacgctttaaaaactttcgaaacatgaaaaaaccgccgattgataataagactaccatcatgatcacccaaaacagaataaaccataaaaaccatccttccagcatcaagcattcccccttattctaaccatattgtatacgaagagagattagaagaacacagtaaaaaaagaatagaaaaaagtgatagacgtctagtcaaaagagatagtagatcatattctattgtatagtgaatctgctatttggccatgggagagtcactagagggtatttgacgataaatggacggaaaaaaaaagtcactttcatagtaggggatgaaagtgactttttatgtttagctgagaggaaattgaagagaaaaagaagagccatcttctgtttctttattgacggcgactgtgagtatttgattttcgcattcggcttgaatggttttgtcattaaaataaaaaggaagcatcatttgtttttcaaaagtctgtcctgacgatttgacagttaagatgaactcgcatccagaaagggtaactgttacttgtgtaggctgtaaaaaagtcagatccgcttctataatatactgctgactagtttcatataaatcaataggcaatgtttcgtcgtaccaggcgaaggggtcttcaaaaaattgccgaagccattcatccatactatcgaaatcatttgcatcgttgcgttttgaatggtccatggaagcattcctccacatatcaaccttgctttacatcatatgcggtggattataatgggtgaacgcataaaaaaacagacactaaggtctgcttttcttacatatcatggcttgagttgtgcttttgtcttgtatggtttcggttctttacttttttgcttccgcttagaggctcaggttggccgggattgtgtcctttaggggcgtttttatgcatatctttacttgtattcttattggtcataaaatgagaacctccttaaaagagttctgtgttattgattggtttttctttttttgttattttggcgttctgcttcagtcagtacaagctggtcgttttcaatatagccggcgcctttgccttggctttttgcgtcattcattccgttaatgacgtgattcgcttttcttttgaccatcattatcacctcaatcataatatggctccttttattgtgttatatgagagagcgtaaacagtaaaaattaccggtacatttttctcataagtcgaacttattgtatttaataaaaacattgatatttacttatgtatgattttgttttaatatgaaattgtgagaaaattgtgatggaatgtaatgttcatctgagaatgatctgatctgaagggggattttggagaatggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgacggcttcgttatcaaaaaagaacacgtggaaaatttggcaaaatggggaactgccgaattaaaggatatcgacgttccgttcaaaccgtctcgtgttattttacaagacttcacaggggttccggcagtagtagatctggcttcactgcgtaaagcaatggcagctgtcggcggagatcctgataaaatcaaccctgaaattcctgttgatctcgttatcgaccactctgtacaggtagataaagctggtacagaagatgcattagcagtaaatatggacttggaattcgaaagaaatgcagagcgctacaaatttttaagctgggcaaagaaagcgtttaacaattatcaggcagtgccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccaaacggaacaacagctactgacttggcgttaaaagtaacacaagtgctgcgtgaaaaaggcgttgtcggtaaatttgttgaattcttcggaccgggaattgctgaactgccgcttgcagatcgcgcaacaattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttctacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcacttagtcagccctgcaggtaaccaaggattcggtttaaatgctgaggaagaaaataaagaaattaagtttaaactccttaacggtgaagaaacagttatgaaaacgggtgcgatcgccattgctgcgattacaagctgtacaaatacatcaaacccatacgttctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttgggtacggctgtacaacatgtatcgggaactcaggtccgctttcaccggaaattgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttgaaaaccgatccaattggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagctttatataaatgggatagcgagtcaacttacattcaaaatccgccattcttcgaagaaatgtctgttgagccaggcaaggttgaaccattaaaaggtttgcgtgttgtcggtaaattcggcgattcagtcacaactgaccatatttctcctgcgggggcaatcggaaaagatacgcctgccggaaagtacttgcaagaaaaaggtgtttctcctcgtgactttaactcctacggttcccgccgcggaaaccatgaagtcatgatgagaggaacatttgcaaacattcgcatcaaaaaccaaattgcaccgggtacagaaggcggatttacaacgtactggccgactggtgaagtaacatccatctatgatgcgtgcatgaaatacaaagaagataaaactggtcttgttgtattagcaggaaaagactatggtatgggatcttcacgtgactgggctgcaaaaggaacaaaccttctcggcatcagaacggtcattgcagagagcttcgaaagaattcacagaagcaaccttgtattcatgggtgtgctgccgcttcagtttaaacaaggtgaaaatgcggatacactcggcttaacgggtaaagaagtcattgaggtagatgttgatgaaacagtccgtcctcgtgaccttgtgactgtaagagcaatcaatgaagacggcaatgtaacaacttttgaagcagtcgtacgctttgatagtgaagttgaaattgattactaccgccatggcggcatccttcaaatggtgcttcgtgaaaaaatgaagcagtcctgatgaatcaataggaagagaaggcatttcgctttctcttctttttatgacacaatgtgctgcggaggtggcatatgctgaaaaaatggctcgcagggatcctgcttatcatgcttgctggttatacgggatggaatttatatcaaacatacagcaaaaaagaagtcggaattcaagaggggaaacaagcacctgattttactttgaaaacgctgtcaggagagaaaagctctttacaggatgcaaaaggcaaaaaagtgctgctcaatttttgggcaacttggtgtaagccgtgccgtcaggaaatgcctgcgatggaaaagctgcaaaaagagtacgccgacaaacttgcggttgttgcggtaaatttcacttcagctgagaaaagtgagaaacaggtcagagcgtttgctgatacgtatgatttaacgttccccattctgattgataaaaaagggatcaatgctgactataacgtgatgtcatatccaacgacatatatcttagatgaaaaaggtgttatccaagacatacacgttggcaccatgacaaaaaaagaaatggaacgaaaactggatcttgattagattcagtttttttatgctcaaatatgcttacaagttttcagaattggaaaaaataaaagaatatgcggaggtgagaagcgtgaagaagatgagaaaacgttcttttcatgagctcgtcatggaaaacaaaaaagagctgatgaccaatacagagtatttaaatcagcttgaggaaaagcttgaacagcgatttaagcaaaaataacctttaatttgtattcatgtttacccctccttttgagaaacctatctgttgaggagggataaacatgggaaacaacaagaaaaacggtcagcctcaatatgctccaagccacttgggtacaaagcctgtaaaatataaagccaataaaggggaaaaaatgcatgatacttcaggtcagcggccgatcatcatgcagacaaaaggcgagtagcgaaaaatcgagtttatttctaggaggtacatccgaatgacaaagaaccaaaatcaatatcagcagcctaatcctgatgatcgctctgacaatgtggaaaaattgcaggatatggttcaaaatacaattgaaaatatagaagaagcagaagcatcaatggagtttgcttcaggagaagataaacagcgtatcaaagaaaaaaatgcaaggcgcgaacagagcattgaagcgtttcgtaatgaaatacaggacgaatctgcagcgagacaaaacggataccgttcttaaaaaaccagggaaacctggtttttttctttctgatttgattatggtaaaatggggctaaattgacgttaagggagcagagtaatcttgcatgtatcaaaaaaagaaatagaagtgcgttatgcagaaacagatcaaatgggaattgtttatcacgcaaattatcttgtgtggatggaggtcggcagaacggccttaattaaggacttaggctttttatatagtgatatggaaaaaagaggcgttctgtccccagtcgttgatatcaacatttcctataaaaagccgcttcattacggagaaaccgcggttgtacatacatggatagaggaatataacggctttaaaaccgtctatggttatcacatttataatccggccggtgagctttccatcaaagccacctcatctcatatttgtgtggataaagaaagctttaagccaattcaattccgcaaagcttttcctgattggcacacagcatatgaaaaggccaaaaaatagggaagtgaacgggatatggcgtttggtgtgaaacgggaggaacttaaccggtggaaacaagcagtgaaaagaggagaaatcgcttttttaacacattactggctggatgaccgatttccagaagcaaggactgtgacaaaagccggctgtgcagacattgataagctggttcagtggggagcggcgtacgggttaaaaaaagaatggctccataagaaaagtgaatttcctcacttcgatctgctgggggaaacacaaaaatatattttggaacaagaaaacctaaccgatcatctaatacgatttcatttgtaaaaaaagaacgcacatgatgtgcgttcttttttattggtattcaaaaaccggttcatcagcgtcttctgaatagctgacgagaaggtcgtggttatcaaagtaccataaatcactttcttcaataaagaaggtaatgccgtcagcttctgcagtgactccagcctcttgtggcgcatctttcgctacaccgagagaaaaacccttttgaacgttgctgcagcctccatagcggacgaaaaagcgaacctggtctccgctttccaaatcgagttcttctttataccagttcaatgcgtcttcgttaattgtcatattcataacagaacacccctttgttcttcatttgaattttctctattataaacgtattaggctattctgtgtcaaaagagaagttttttaagcttataaccattttactttaggttctgttttattgataattcgtttaatgttcgctcggtgtctgtatatcacaaaaatagtgagcagggtaacgacaatcaataaatacgtatcatggacaaagaaactatatataacagtatagatccctgttaacatcgatgagagagaaacaaatttagtcaagtataaaaagatgaagaataccgcaaccatcgtgataaataacaggggtgcgtaaaatagcaaaacgcctcctgatgtcgccacggctttaccgcctttaaatttggcgaagatgggaaacacgtggcctaaaaccgcaaagactcctgcaagaagcgggtgaatatcaacatgcatgagaaaaggcaatgcagttgccagtgtccctttcaaaatatctccggctatgacgaccgaaccagcttttacacccaatgtacggaatgcattggtagcgcctaagttgccgcttccgtgctcccgaatatcaattcccttggcaagcttgcccacaattaagccagatggaatgctgcctatcaagtaggccaaaataatcaataaagcaattaacatctacatttctcctttttcaaattcccttctttttattttaacatgagatgtcatgatctgatgataagtttttttgtaaagtttgcttacaaatccaatcaaacatgcatcatattttgatttctcctgttttgatcgtgtaaaataagtggaaaaggagtgacacacgatgcaaaacccttctaaagcggaaattaaagagattcttcaaagaagcaaacgtatagccgtagtagggctttcagaccgtccggatagaacatcacatatggtttcaaaagcaatgcaggacgcgggttatgaaattatccctgtgaacccgacaattgatgaggcgctaggtgtcaaagccgtttcatctttaaaagagatagacggtccgattgacatcgtaaatgtattccggcgctcagaacagcttcctggagtggcggaagagtttttagagacagatgcgccagtcttttgggcacagcaagggctagttaatgaagaagcataccagatgctaaaagaaaaaggcagaacggttatcatggatctgtgcataaaagtggcacacgctgtaacaaaataggtgcagaactgcaaaaatccttgtaaattcaaggatttttgctttttaattttaagatattgtttgcgtattacggtgaaacagatacaataaagcttgaacagctttttttgaataccttgtccagctgggtttcggccgttcgatttgcgaaggtctgctgctttatatataataaacaaacatacgttctcatggtgtaaaaacagcactagcctatgttttgagaagaactgattcgttagctctatgttgcgattgcaaacatattggttataatgaggagtccaaggcagtactggctcgaggcgaggtttataaaaaatatcttatatacaaatgatgtgtaacactgaaaaagagaaagacaatgttagtttttgaaaggggtttgtacgtttggctagaaaacagcaatttgattacaacgaagatgccatacaggtgctcgaaggccttgaggctgtcaggaaaaggccgggtatgtatattggctctactgacgcgcggggtttgcaccacttggtttatgaaattgtagataactctgtcgacgaggtgcttgccggccatggagatcacataatcgtcaaaatacataaagacaatagtatttctgtacaggatagaggccgcggcatgccgaccggaatgcataagctcggcaaaccaacccctgaagtgattttaacggtgcttcatgccggagggaaattcggccaaggcggctataagacaagcggcgggctccacggagttggtgcatcagtcgtgaatgctttatctgaatggctgacggttaccattgagcgggacggttttgtctatcagcagcgatttgaaaatggaggaaaaccggttacatctctcgaaaagatcggcaaaacaaaaaagacgggaactcttacacactttaagccagatccaacgatgttcagcacaaccacttataattttgaaacgctctctgagcgcttaagagagtctgcgtttttgttaaaaggactgaaaattgagctgattgatgaacgcaatgaccagcgtgaggtcttttattatgaaaacggcatagaagcgtttgttgcttacttaaatgaagaaaaagacgtcttgtctgaagtggtctcgtttgagggtgagcatcattctatagaagtggactttgcgttccagtttaacgatggttattctgaaaatattttgtcgtttgtcaacaatgtcagaacaaaagacggcgggacgcatgagtcaggtgcaaaaactgcaatgacgcgtgcttttaatgaatatgcgcgaaaagtggctttgctgaaagaaaaggataagaaccttgaaggcaccgatataagggaagggctttcagccattatttctgtccgcattcctgaggagcttcttcaatttgagggacaaacaaaaggaaagctcggtaccagtgaagcaagatcagcggtggatgcgattgtttcagagcagcttgcttactttttagaggaaaatcgggacaccgcaacgcttcttgtcaaaaaagcaatcaaggcgagccaggcgcgcgaagcggcacgcaaagcccgtgaagaagcaagaagcggcaaaaaacgaaaaaaatcagaagcgactttaagcggaaagctgacgcctgcgggttcaagaaacccggcaaaaaatgaattgtatctcgttgagggagattcagcaggcgggtcagccaagcagggacgagaccgcagattccaggcggttctgcctttacgcggtaaagtcattaatacagaaaaagctaagcttgctgatatctttaaaaatgaagagatcaatacgatcattcatgcgatcggcgggggagtcggggcagatttctcaatcgatgacatcaactacgacaaaatcatcattatgaccgatgccgatactgacggcgcccatattcaagtgctgcttcttacctttttctatcgctatatgaaaccactcattgagcatggcaaggtgttcattgcgctgccacctttatataaggtcagtaaaggaagcgggaagaaggaaatcattgaatatgcatggtctgatgaagagatgggtgatgtcctgaaaaaagtcggcaaaggctataccattcaacgatataagggtcttggagagatgaacgcagaccagctgtgggaaacgacgatgaatccggagtcccgcacacttgttagggtcaaaattgacgatgcggcacgtgtagagagacgtgtgacgacgttaatgggagacaaagtagagccgcgcagaaagtggattgagaaaaacgtcgctttcggcttagatgaagaaagcaatattttagaaaatgaaaacttatcggtcgctgaggaggtttaatgattgtcacagccagaattatttcatgatttaccattagaagaggtgatcggcgaccgttttggacgctacagtaaatatattattcaagacagggcgctgcccgatgtgagagacggattaaagccggtacagcgcagaattctgtatgcgatgcatacagatggaaacacgtttgataaaaacttcagaaaagcggccaaaacggtcggtaacgtcatcggtaactatcatccgcacggtgacagctcggtttatgaagcaatggtgcggatgagccaggattggaaagttcgtaatgtgttaatcgaaatgcatggaaacaatggaagcatcgacggagatcccccggcagccatgcgttatacagaggcacgattatctccgattgcatctgagcttcttcgggatattgacaaaaacacggttgaatttgtgccgaactttgatgatacaagcaaggagcctgtcgtactcccggcgatgtttcctaacctattggtcaacggatctaccgggatttcagcaggatacgcgaccgacattccccctcatcatctgggagaagtcattgatgctgtcattaagcgtattcaaatgccatcttgctctgttgatgaactcatggaagtcattaaagggcctgattttccgacaggcggtattattcagggcgttgacgggataagaaaagcttacgaaaccggaaaaggaaaaatcattatccgcggaaaggctgaaattgaaacaatcagaggcggacgagaacaaattgtcattactgaaattccatttgaagtaaataaagcaaaccttgtaaaaaaaatggacgagttccgtattgataaaaaggttgaaggcatctcagaggttcgtgatgaaacggatcgaacagggctgagagtggtcattgaactgaaaaaagaagctgatgccaaaggtattttgaatttcttatacaaaaacactgatttgcagatcacatataacttcaatatggtggctatccataaccgccgtccgatgctgatgagcctgccgtctattttggatgcatatatcggacaccaaaaggaagttgtcacaaaccgttccgtttacgagcttcaaaaagcaaaagacagacatcatatcgtagaagggctcatgaaagctttgtctattttggatgaagtgattgcaacaatccgttcttctagcgataaacgtgacgctaaaaacaatttgatcgcgaaatatgaatttacggagcctcaggctgaagccatcgtgtcattgcagctatatcgtttaaccaataccgatatcacagcgcttaaggaagaggcagaagagctcggtaaaaaaattgaagagctcgaatctattctgagcaatgataaaaaactgctaaaagtgattacaaacagcttaaaagcactgaaaaagaaatatgcagatacgagacgctccgtgattgaagaaaaaattgaagaaattaaaatcaatctcgaagtcatggttgcatctgaggatgtatatgtaaccgttacgaaggatggttacctaaaacggacgagccagcgctcatttgccgcttccaacggtcaggatttcggaatgaaagatacggacaggatgctgcatcagtttgaaatgaatacgacagacgtgctgctgctctttacgaacaaaggaagctacatctattgtcctgttcaccagctgcctgatatcagatggaaggacatgggccagcatttttcaaatctgatcactattgaccgtgatgaaacgattgtaaaggccataccgataaaagaatttgatccgtcggcatatcttctattctttacgaaaaacgggatggtgaaaaagacagagctcacccattataaagcacagcgttattctaaggcgcttgtggccttaaatctgaagggtgaagatgaactgattgatgtacatgtaacaaatggggaaagccagatctttatggccactcacttagggtacggtctatggtttggagaagacgaagtgaatgtagttggcgcgcgtgcggcaggtgtcaaagggattaacttaaaagaggatgactttgttgtctccggtgagatccttcagcaatctgattcaattgtcttgttcacacagcggggagcggtaaaacgcatgagtctttctgagttcgagaagacatcccgcgcaaaacgcggtgtcgtaatgctaagggaactgaaaaagaatcctcaccgtgttgtagcactgttcgcttgcggtcttgaacagcgactaatggcagaaacagaaaaaggcgacagaaaagaactgcaggcaaaagagttgcggacaaacgacagatacagcaatggctctttcttttttgatgaagaggaatcaggtaaggttacagctgtttggcgccttcatacagaacaataataaaaaacccgctcatactatatgagcgggtttcgtttgttttttatcagctttcatggttggtgaatagatctgttacagcatgaatgacttcaatcccctgccatacaaataaattcagcgctgtgaaagaaaataagcctaaaatcaccattcttaagataaacaacatgtttaacagcctcctcatattttcgttacataatcgggtgatgttgaacatgaagtttgccgaaataagacgattgataaaatttggccagtataaagctttttttccgctgacgtctgcgggagtatcccgtacttttgctttcagcggtcagcagcagaacagccattgcccataaagcggtcagcgtaaatgcccctgtgatggatttcttctcatcatcagcattttggccggctttcatctcatgcatttcctgctggtcggctacggctttataatgatggccgatatcaaaggcgtggggaattgagaacaaatgaaaactggcaatcgccaagaataagatggatgctttcaatatcgttacttttttcaaatgatctccccctcctttaatattactgaatatttttataataataccccgatccatcctaaaagtaaacctgatttattaaatttaaaaataaatttaaccttgttaagtatatatctttttgcttatttttgaaagagaaaacttcttttattagcgtatgtatacctggtttatggtgtgaataaaaacatattttaaatgatatgtttgttgtttagggtttattactttatttatgtgctaaatcaaagggaaaggcaagagaatgggaagaaatgattacattgttaataggacactcttttttaaaagccagcttgcaaggaatgtttttattcgtaggaaaataatagagaaggggtcgacagagtaacatctggctatgacaatattcttctcgaaaaaacttcctaattcgtcatattgtgatataataaaactcgttatgttaaaaaatctaacatcaaaatcgaattcgtgttgaattgatgaaaacgggaggtaaatatggagtcttttttcaatagtttaattaatattccaagtgatttcatctggaattacctattttatattttaatagggcttggattattttttaccatacgttttggttttatccaattccgttattttattgaaatgttcagaatagtaggggagaagccggaaggaaataaaggtgtttcatctatgcaggcattctttatttcggccgcatcccgagtcggcacagggaatttgactggtgtagccttagcaattgcgacaggcggaccaggcgctgtattttggatgtgggtagtagctgcagtaggtatggcttcaagctttgttgagagtacattagcgcagctttataaggtgagagacggggaggatttccgcggaggcccggcttactacattcaaaagggtcttggagcgagatggcttggcatcgtttttgctgtcttaattaccgtctcattcggcttgatttttaacgctgttcaaacaaatacaattgctggagcattggatggcgcattccatgtgaataaaatagttgtagccatagttctggcggttttaactgcgtttatcattttcggcggtttaaaacgtgttgtcgctgtttcacagctaattgtgccggttatggcaggcatttatattcttatcgctttatttgttgtcatcacgaatattacggctttccctggcgtgatcgctacaattgttaaaaatgctttaggttttgaacaagtcgtcggcggcggaataggcggcatcatcgttatcggtgcgcagcgcggacttttttcaaacgaagcaggaatggggagcgcaccaaacgcggctgcgacggctcatgtatcccatccggcaaagcaaggctttattcaaacattaggcgtatttttcgatacatttatcatatgtacatccacagcatttattattttgctgtacagtgtaacaccaaaaggcgacggcatccaagtaacacaggctgctcttaaccatcacattggaggctgggcgccgactttcatcgcagtcgcaatgttcttgtttgcattcagttcagttgtcggcaactattattatggcgagacaaacattgaatttattaaaacaagcaaaacatggctgaacatttaccgtatcgctgttattgctatggttgtgtatggatctttatcaggcttccaaatcgtttgggatatggcggacctctttatgggtatcatggcgctgatcaacttaattgtgattgcgctgctgtcaaacgttgcttacaaagtgtataaagattacgcgaaacagcgtaagcaaggacttgatcctgtgtttaaagcgaaaaacatcccagggctgaaaaacgctgaaacatgggaagatgagaaacaagaagcataatataaatataaaacaaagctgcattcaatagttgaatgcagctttttcattattggaaataaatttaatttatcgactcgaatgaaaaatgacgtgtaaagtcccaattcagtccagttttctttgttctatatgtgtcatgtgtgtcttattcaatggagatagagtaaattgacaggcttttaaacctcccaaaaacaagaaattaggttgatagacaatcatgagaaagatttttacaatgagttcgtgctcataagaagtgaagagccaaaatgatgcgaaggaggaaaagatcagatatgaaacggtcaatctctatttttattacgtgtttattgactacgttattgacaatgggcggcatgatggcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagggacgattggggtatcaccgttttccgtgcagcgatgtatacgtcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagtctttacggtaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaggatgtaaatgatgctgccgatgaccagctaaaagatgcaaacgttatgtacgcacttcatttttatgccggcacacacggccaatttttacgggataaagcaaactatgcactcagcaaaggagcacctatttttgtgacagaatggggaactagcgacgcgtctggcaatggcggtgtattcctggaccagtcgcgggaatggctgaaatatctcgacagcaagaccatcagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccagcaaaagataaacccacacaggaaaacggtatttctgtacaatacagagcaggggatgggagtatgaacagcaaccaaatccgtccgcagcttcaaataaaaaataacggcaataccacggttgatttaaaagatgtcactgcccgttactggtataaagcgaaaaacaaaggccaaaacgttgactgtgactacgcgcagattggatgcggcaatgtgacacacaagtttatgacgttgcataaaccaaagcaaggtgcggatacctatctggaacttggatttaaaaacggaacgctggcaccgggagcaagcacagggaatattcagcttcgtcttcacaatgatgactggagcaattatgcacaaagcggcgattattcctttttcaaatcaaatacgtttaaaacaacgaaaaaaatcacattatatgatcaaggaaaactgatttggggaacagaaccaaattagttaagctttttttggcggacatcagtaacgatgtccgtttttatcatctaataggaggtttgcgttgtggatgaaatactgaaacagtatatggtgctgtacaaaaaaatgagtaatatgataaatggtccggactatccaggtaaggaaaaagacatccagcatcaaaaagatcagatcgaagtttacgaaaaacagctgcagcaaggattttctacagattatgactatgatgtgtttgctgattctgttatcaaatgcgcatatggcgatatgacgctggaggatttagaagcagtttattatggattgacaacaccatttttttgatttgtcattcagcagtaaaatttcaaaatttcaatttctgtctcactaacttaagtatactttgatattgagacagaaatttatttattttaattacttcctagaatatatattatgtaaactaaaaagcggattcttttaatagttattaactcttggccttccaccttttcttcctctagctctagctgctttaagcccagacaatgttcgttcacgaataatgttccgttcaaactcggccagaaacgattacataccaaaatgctttaccaggctgcgtacttgtatctaaaacatcttgtatactaataaattcgccacaaatagacaagagcttgtatcacttagatactagctctttttgtactaaagccctccttaattgaattaaccgcgtgttcttatgtgacgttggattcaacggctaactctttgatatgcgtttatcacagcctctcggttatgtcacttgttgctggtcttcttgatcaagtccacgccatcgtatgccagactttccacacttgcagccttctgcagtaagtaatgatcaaaaaagcttttcgtgtagtctgtaacaagatttcgcatctccatagcatcccgtttgcctctgagttcctcattaacactggtaaacacgatgtcgcagtaatctaaatgcgcagcacgatcaacagagaaataataggtttccatgctattgttagcgccaattatcgcactcatgttatagttaggttcacaaaacagtagcaagaagggtttcttaaggtcgctgtcgagaaggccgaacgcaccgctatccaagcctatcccgcaggcgaaccgttcgtcgtcccggcaaactatcgccgtcgtaggccctccataagaatgtccgactatgcccatgccgatattaagccataatctgcccttaaagatggaattcagttctccagagtccagtttgaaaagataatcggctacataccttatatcttctgcctgtaattcgctatactctgttaacttggcaagtatcggcagtgtaagcacattttgacacatctcaatggccgtttcatcgtcaggccgcatctccatcttaccagccaactccaccatctccggatcttcagaaaacgccataatgacatccgaaaaatcctttgatacattaaacaggcgcccatctttacgcttatacatcgtgctattctgatggccgatgcttaccactacatatcccatgcttgccaagtctgtacagatcacagtaccccattctggagaaccgcccccgccgcaaacatagaataacaccggatagcgcttttccttcccggagagagcaaggtcgtcgtaacactgggtcttgatatcgatagagtaagcatccttcaacgctgtgagaagcggctgctcattcaacatctcgtagacttcaggaaacatgtacgttgatgtagtcttaccttcgctactgtcggacggatagtacacaaacgccgtcagttctctttttgagtgatctgatgccgtgtactcaaaatccatctgggttcgaccgacagtatagccgccaattggttcgggaaatgcgtcataagttatcactttcttcttcccccttaattaataaaagtggcgaatgaaactacatacattgcgctttaagcgcttttcaaaactgtgaaactattacatccatcttcagtgaatcatatctactccttggctatcttgagatcgtcagaaaatttatgatcttcaagcagcccatgactcaagcgttctacatttccccttccatgaatattcataatatctcagtaatagtgcaccagtcgtgttgatgccctcctacatttaaaaaccttgaatcatgcgtctttaaaacgacgtacgacacgaaaaaagcgattttctgatcggaaaatcgcttttttcagacttcgacttttttattcccgtgcagggtttagattcgtatccgctccaatgcggtaccgcttgtcttggtgtccttaacgatttacaacaaatgttgtcacgctttgagctggaagatgggccaaaaatgattgcctgatacagtgagattcgttccaggttgtagattgctgctgctgctcgtgatccatctagatacgtttgaagcagatccattctgcaaaacaaagttttggttgactcctgtgttgcttttattgatggcaacaataacgaccttgttgtcacctttataggctgacacgtaaacgttcgcattagggtttttcgttgcatcaatccttacatagccgggacgcacaaactttgagaaatgagccatattgtagccgcgtttgctgatcgtgccgtcttctttcataggaccgtatgatcttcggatgtaccaccaaacataagcttgaaaatctccctctaccatcgaactgtgaatatgatgtgaaacatccaatgcctcaggccatcgatccgccgagttgttatcactgttcggatagtatacttccgtcatccaaaggtcctttcctgctcctttttgtttgaaaagaggataagggaattgactgacctgagtgccgtacaggtgagttccgagaatatccatattgccaagagcctgcggatcgtttaaaattgggtccgacaaattcttcaagtattgaaatgactcaggcgcaatgacgcgggcattgatcgagccggcgttttctctcataaagtgaagtatttcttgcggcgtccaccacgtccactcgtgagcgtaatcaggctcgttttgtaccgaaatcgcgtaaagattcacaccattattcttcatgaaggtaacaaaatcgttaagatgctgcgcgtatgctgcgtacttgttgtatttcagccgtttagccgatgtgtcaccattacgattaaaggtctcaaccatatcacttggaggattccaaggagaagcaaaaacgattgctccatgtttgaccgcactctttgcagtctccacctctttataccaattatttcgattttcatctacatgaattcttaagattgaaaatcctaactggttctgtccattgccaaaagcagtttctctttgagctgctgtaagatccccaatccaagccgggtgattcatccctccaaaaccgcgaatcacttgtttctctgcagatacattaactgttacatcactggctgccaaaacttcagtagcgcctggccctaacatgactggcaacatagtgaaacatactaataatacacaaattgtttttttaatgcgtggaatcatttattcctctccttcgtcatgtgtcttttacggtattaaaaatctgcatggcatatcgggctgttccggtgctggcccgtacttcacccgcctcgtttttaagcggtcccattacgagtactatctttgcgtaaactgccagtaatcaaaattaagcaagtttcctgtacctgttccggtaaatacaaagaatactttgtgcacaccggttgccccgcttactggagtttctatttctctccacgtttgcgctccacctgtggaaggtacatttagggttcctacaagtttaccgtctgcactgtcgaggcgcacttctattttcccgcctatagtggatgctacatttgctttaaatgtcctggcaccgcccgctccgaagtctgcatttcctacagcaatccagtctccattttgaatgcttgttacatgctgattatttactggcccgccgggtgctgtcgatttctctgtcaaaatgcgtccattccaagcaaacgtttcagcttctacccggttatatgggtttaaattggaaagctgtgttacacctgcataatttgccgctacctcttgaatagatccatctgcattatgcaccagcttattaatatgtggagaacggtatcctttgccggcccgaacaaagcggaactgacagtttgagcatggtacactgcataccactcgtttttaaaattgaaaacagcatgatggttgtttccgccgcctccgaaaaatgcacccggatttttcaggaaatgccctctatatgtaaaggggcccatgggacttgaacttgtcatgtagccgatctcacccgggggtttatcggccggatgcgtgccgccgaaattgatgcaataggagtaataatatgttccgttatacttgtgcaatcccgaatcttcaaacatgaaaggcgcatcaattgtagatgcacttccaacaacactcgtcatatcagatcccaattttatgactctagccgttttaggattggcccattgtgcctgcgttggatttgaaccgccaggaacgcctccgccggcatacaggtaaccggttccgtcatcatctacaaatactgccggatcaaaaagccatacaacaccagacattcctggcgtacttggcgttacgagcggttttccgattgggtcggtccatggaccaatcgggctgtctgcggtgagaaccccgatacctccgccgctgtttgcgaaataaaggaagaatttatccttgccattgatttttttaactgcgattgacggtgcccatgacgcacctgcccattttgcaattccacggcctccattagctccattgacacctgctaccggaatggctccgtggtctgtccagttcaccatatccgctgaagatatgacgaatactctattcaaattggcaaatgaattatctttaattgttccgttgctattatattcatagtcatcacttgacatatagatgtagactcttccgttataggtcagcgcaaccggatccgctcccaaatgatggtcgataagcgggtttgaattccctatatgttttgcaattgtagtatttgtggcagcatacgcagacttcccagctaagcagctcaaaagtaaagcaagaacccataaacatacgctatactttttgctcatcacttcacatcctcccttttccaaaatagggtatttccttttgaaattttgatgacaacaggtcacgaagaacgcacgcataaagtagccggaagctgtttagcctggaaaattaattttgcatacatggatcgaatgttcccagttcctgttctgaaagctcatcttcatgtgtttccattctctccttccttcgaggagatcgcaccactccttcaaaattgttcaaaaaaatttccccattcctagcgaccattgtccagaaaataaaaagacaggattgttcatggcctcccactaatcacattgaacggaaattacatcattatccaagatatccctttatctaacatcctacatcattaaaaaaattgtgtatagaaacttttggaggagttagtgttcgattctacaaaggaactggatacatttattcattgataagatggggctaacactccgtttatatttgtatgtaaagatagttttcagacacaaaaaaacagccgtcaatgcggctgttttttcaagagtataagaactattgagcggtatacccgctttttcatgttttgttcatattttattaattgtttattcaacactgtccgctatagtaatccatatcaacaaatatgactgccactcgcatcttttatgaagggaggttcgttacgctgaaagaaaaaataaagacattaggccgtttttgcaccgtaggcgtcggcaatacgctgatagattttggtgtcttctttcttcttaccgcttgtcacgtctcttatctgccggcgcagatctgctcctatactgcaggtatcgtcaacagctatgtgtggaaccggaattggacgttttgtgtgaaaggtaaggctgacgggaaagagatcgtgcgttttctcatgattaatattgccgcgtcagggatcacctttttgctgctttatttgtttcaaaactgtggctgttcgctattggtgagcaagctcgccgccactatcggcggaatgatgatgaattttattggaaaccgaatctgggtatttggagattcgctgaaaaacatacaggatcaggagtgaggatgaatgagaaaaaaagtgagaaaagcggttattcccgcagcgggtttaggaacgagatttctgccggcgacaaaggcgcagcctaaagaaatgctcccaatcgtcgacaaaccggcgatccaatatattgtagaagaggccgcagagtcaggaattgaagatatattgattattacagggagaaacaaacgctcaattgaagatcattttgatcggtcggcggaattggaattcaatcttcgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgccgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatacgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccacgcccggctgctggaaggaaatcgatatgacattggcgataagctaggctgttttaaagcgagcaccgaaatcggcttaatgcgttccgaaatgagatctcagcttttggcctatttagaagatgtgatcaaacgggaaacgaaagaaatgctgcggtaaaaaaattgtaaccatcttgctcgtcaatcagtcatataatagtgaaaaagattaggacaggttgtgaagaatgtgggcagtttgataaacgaaattttaacatggctgacgaacatgggatatgcgggtattgcgattgggttaatgattgaaatcattccgagtgagattgtattagcttatggcggctatatggtatcggaaggcacgattggatttattggcgcaattattgcgggtgttattgggggtaccattgcccagatctttatttactggatcggtcgctatggcggcaggccatttctggacaaatacgggaagtatttattgattaaaaagcatcatatcgacatgtcggaaaactggtttcagaaatacggcgccggagttgtcttctcggctcgttttataccggttgtcagacatgccatatccattccggcaggtattgccagaatgccttttctcaaatttgtggtactgactgtgcttgctatcattccatggtctattctgtttgtttatttaggcatacagctaggaagccagtgggatgatgttgagaatatagcgggcacttatacaacaccgattatgatattggctgttgtcgtgatagccctttattttgtgattaagaaacgtacagccatatttaaacgatagctagcggatatgcataggggtgactgacgctcccctatgcatatttttttacttccgatgttgatttgccagcttcagattctccgctaaaaatgcgacaaacacttcatcccgcacgagcgatgcggcataatttctcttaataaaccattctgcctcttcaaacgctgcgaatgtttcgtcttgggtttctccgttaatttgaatattccattcgttgtctatagggaaaagaaaaaatctcatttgtgcgcgattttcatataatgatccattcgcagatccctttagattatagatgttacggaaggcatccggccgtacaggatcaatacggaaagcttcagctacaaacaactcgtatacttcatcggttattgaacagccggacgcttttgcatgccctccgccgccatatcggccggcgatttctgacacatcgatgtaatcatgaatggtgcggagactgactcgttttgaccccatgctcaaaatcgcaatgtaatcgaggtgcggattatctttccctagcctgttccccagctctgaatggtacgattcagcgtgaacgatgcctacacagtgttcgtgaacaaaggtttgtaccatttcccttttctttctgcggaggtagcgctcgattttttcgtcttctaaatcaagcagtttttcttcaaaatcatcgaagaaaaattcgtcatgcgcggaaaggcgctggatcatttttgcttcaaattcatcgattgacagcaaaaagaaaagatcattaagccgcttcgcctgtttttgatcgtaccgctcccactcccatgtatcgtattggcggacgagctctgtgaattgatctaaggcatttgtcggtttcatgaagccattttcaacgagataaccatataaaagcgatgtcgcggatgtgagccttccatcatcgtattccacctggacaaatccccattcatgctcattcaaatgaagagctgttttatgatggtcaatgagcttcactttgccccctgcatgaacatactcattcaatctctcttcgttttcttcattgacggcgagatcggtgatgaataacgcgtcctgtctgttgctctccttcgctttttctaaaaagtactgcacctgtgcgtttaagccgttgacagagttataccggacctctacgtcttttccgaacgccaattttgctacgattccgcatcctactccgtccaagtcgttatgtgaatataaatgatacataatgtaggcccctttttatgataaactgacaattgccgctagaggtgcggcagcctttatttactattctaaaaaacaaagcgttttatgcaaaggtaattagttgacataatgttgttattgtaaatatataaaggagcgctttttttgcgctcctaagttcttgcttttacactggataaaccggatgctttcgattggtaaatgtcatttcctttgtcatgtatgccttgagccgtttggccagctcatcacgcagcgaattggctgggataacagcatcaatgatcatttctgaagccagacggtagatattgatgtcctctttgtattcctcccgtttgctgctgataaatgcggctctctcttcttctggcagctcggcgatttttttagcgtagacagcgtttacagctgcctcagggcccatgacggcgatttgggcggttgggagcgctagacagcaatccggttcaaatgccggccctgccattgcatacaaccccgccccgtaagcttttcggacaatgacagagagttttggaacagttgcctctgacatcgcagaaatcattttcgctccgtgtctgataatcccagcctgttctacttttgtgccaatcataaaacccgggatatcggctaagaacagcaatgggatatgaaaagcgtcacataaggtaataaacttagccgctttgtctgctgaatcgtggaataagacgcctccttttaccttcggctggtttgcaacaatgccgacaggctgtccgtggattcgtgcgaggcccgtcaataattccggtgcaaataaggctttgatctcaaaaaatgagtcttcatctatgacccgctcaatcagctcatgcatatcaaatggtgcgttttgattttgcggaatgacgtcggcaagcggagtttcgaagtgttttggcgggcgtttctcatgaataggcgctttttcttgaaaatttgtcggaaagtaggacaaataagcccgcgccagctgtatggcttctacttcagtttctgcaagaatatctccgcagccggagattgagcaatgcatacgggcgccacccatttcttcaagagacactttttcgccaataaccatttccgccatccttggcgagcctaaatacatggaggcgttaccgtctaccataacgacgatatcacagaaggccggaatataagcgccacctgctgcagatggtccgaaaagcagacagatttgcggaatgcgtcccgataatttgacttgattgtaaaaaattcttcctgcaccgcgtctccctggaaagacattgatttggtcggtaattcgggcgcctgccgaatcgactaaataaatgagcggacagtttaatttttcggcggtttcttgaattctgatgattttttcaactgttttagctccccatgaccccgctttcactgttgaatcattcgccatgacgcaaacagtttggccgccgattttgccgatagcggtgacaactccgtcagcgggaagcccgtctgacatacattccgcaaaaaaagcgtcttctagctcaatgtcatcgtcaaagagaagggaaagccgctctctgacaaagagcttgcctttttcccgattgctttgatgatacttttccgctccgccttttcgaatccgttcagcccgttctgttcgttccttttcataatccatgagcattgcctcccttttatattcccttgtatacggcccgtcttttttcttgaaaggcctgaagcccttctctcctgtcttttgtcgggatggtttgttcatacgctttttgttcaatcgcaaggcctgtagcgagatctgtctccaatcctctattgattgcaaatttagcctgacggacagcgatcggcccgttggcagaaatggctgcggccagttcctttgcttttggcataaggtcacaaggagcggtgacatgctctacaaggccgatttcttttgcttcgtgtgcggtcacgcgtctgcctgtataaatgaattcttttgcttttcctctgccaatcagccggggcagcctttgggtccctccagcgcccgggataatagctaaccctgtttccggaagtcccagcacagctgattcagttgcgattcgaaggtcgcatgccaatgccaattctagtccgccgcctaatgcgcttccatttatcgcagctatgaccggctgcggcaaggcatcaagtaaagccgccgttctttgaatgagagatacactttccagaacctgatcttctttcagttttatccgttcctttaggtctgcccctgcacaaaacgctttttcaccggtgcctgtgaggatgacgcaacggatgtttgagttaaattcaatttcctggataatcatttgcaggtttctaagcatttccgctgaaagagcatttgctgcctgaggcctgtttaaggtgatcaacgcaatatgttcatttttaacagtaaaaagaatagaatctcccattgtatgcgtcctcccttttatcaagatgatttaaacacctgtaaatttctgctcggcagcggtttgcccattttttcttcaatccatttggccgcagatagcagtttttctagctttacatttgttttgatatccatctgttcaagcatgtacacgatatcctcagttgcggcgtttcctgatgaacctggcgcatatgggcatcccccaagcccgcctgccgagccgtcgaacaccgtgatgcccatttggagtgctgtgaccatgttggccagagcggttcctctcgtatcatgaaaatgcaaggcaatttgattagccgggaatcgtgccaaaagagcttcaagtacagtttccacttgggcgggattagccgctccaatcgtatctccaagcgaaagttcagaaatcccaaattcaaatagagcttctgaaaggcgaatgacttgttcaatggggacatctttttcgtacggacagccgaaaacagtcgagaggtaggctcttgttgtgaggtttgctttttgtgcgtcgttgtttacttgtttgagtatatgaagggattcagaagtggatttattgatgttttttctgttgtgcgtctcgctggcggacataaaaacgcaagcctcgttaatgcctccttcaagtgcattctccagtcctctttgattcgggacaagtgccgcgtacgttacccctttttctcggtcgatgccttttgctacatcgatagcatctcgaagcgccggaatccatttcgggtgaacgaaggatgtgatttcaatataagaaagccctgtcctggaaagctggttgatccaggttattttatcctctgttgagatccatacgggctcgttttgtaagccgtcacgcgggccgacttctttgattgtcacttttttaggatatgtcatggtcttcctccaaattattgagtggaatcgctcagttcgagcagtacgtctccttcatttacaaagtcgccttcattttttttgacttcttttacgattccgcttctatctgcaacgatcgggatttccattttcatcgattccaaaatggctacctcctggcccttttcgatttggtcgccggctttgacgtggactttccacaggtttcctgccatttgtatgttaaccgtcatgacaactgcctcctttataggtgttgtttcaaaaagtcagtcgtgacatccccttctttaaatgcctttgttgccgcagcctgtatgagaagcggaagatttgttttgattccctctacacgatagtcgcgaagcgctgtctctagtttttcaattgcttctgttctggtttggcctttgacaatcatcttagcgatcatcgggtcataaaaaggggtaacggtgctgtcttttgctaccgcacattcgtgtctgactcctttttggtcaggaagtgaaaacgcagtgatcgtacctggtgacgggaagaaggtcttgggatcttccgcgtatattcgaacctctatcgcatgcccgttccgttggatgtctttttgggagaatgtgagtgtatggcccgcagcaatccgcagctgctgctcaactaagtccaggcctgttatttcttcagtcacggggtgttcaacttgcagtctcgtattcatttcgaggaaataaaaattttgcttctggtcaactataaattcgatggtgcctgcgttcgtatagccgattgccttcgctgcttttaccgctgtttgcccgatcttcattcttagttcatcgtctacaaatggagacggtgcttcttcaatgactttttggtggcgcctctgaacagagcaatcacgttcaaacagatgtactgtatggccgtgttgatcggccaaaagctgaacctcgatgtgacgcgcatgttcaataactttttctatatacatcgacccgtcaccgaaaaaatctgctgcgcgttttttgtttccctcgtacgctttttttaatgcttcttcattttcaacacgctgcattccgatgccgcctccgcccgctgaagctttcagcatgacaggatagccgatttgacttgcggtgcggcaggctgcctctatatctccgagggattcagaaacgcccggcaccacagggactcctgcagcctccattgcttttcgcgcttcaattttgctgcccatctttgcgatgatatcaggggaaggcccgataaacacgatgttttcttgcttgcagcgttcagcgaatcggctgttttctgataacaatccatatccagggtggatcgcgtcggcatttgcttttttcgccgtttttatgattctctctatatttaaataactttcactgactctcgattccccgatcaaataagcctctgtagcggcttttgtatggggcgcgtccttgtctgcttctgaataaaccgcgaccgttttaatgccgagacggctgcatgttcggataattctcattgcaatttcaccgcggttggcgatcagtacttttgtaaacatgatttcacctcattgacttgatgataagttgaacatttcaatcgttttttctcgcagtttatatttttgaattttgcctgaggccgtcatcggatagtcatccgtaaaaataacataacgcggaattttgtggcgggcgattttccctttgcaataggctttaagctcatcaggtgaaacgcttttaccgtctttcagtttaatccaggcagcagcttcctccccgaatttggcgtcaggcacaccaacgacctgtacatctaaaacagcgggatgccggtataaaaattcttcaatttcccgcggataaatgttctcgccgcctctgatgagcatatcttttaatcttccggtgatgcggcagtacccgtcttcatccatgacagcaagatctccggtaaacagccattcgtcgtgattgattgcttttctggtcgcttctttgtctttataatagcctttcatgacgtgatagccgcgggtgcacagttctccctgcatgcctctttgaacttcttgacatgtcccgggttctacaattttcacttcagtatgtggcagggcgcggccggttgtttcgactcttcttatgaaggaatcatttgctctcgtttgcgtaatgactggcgaggcttcggtttgtccataggcgatcgtaatgtctttcatgcccatcctttcaatcacagctttcatcacttcacttggacaaggagagccggccatgattcctgttcggagcgtcgatagatcatatgcatcaaaatccggatgatgcagctcggcgataaacatggtaggcacaccatggagcgccgtgcatttctctttttctaccgttttaaggacggtaacgggatcaaattcttgcacgggtatcatggctgccccgacggatacacatgctaaaaccccaagcacgcatccaaagcagtgaaaaaacggaaccgggatgcacatgcggtcttgagaggttaaaaccatacattcagcgatattagcagcgttattgatgacattgaaatgggtcagcatcacgccttttggaaaccctgtcgttcctgatgtgtattgcatattaatcacatcgtctttatccaggctgttcattctctcttcaagctcagcatctgtcactgttttcgccaatatctctgtatcgtcccaatgatacatgccaggcaaccgtttattgccaatatagatcagcgtttttaaaaagggatagcgttctgatttcagttggccgggcattgcttcttgcagttctggtattaaactgttcacgatgtctggataagaagtgcctctgtatgaatccatgatgataagtgccgcggcatccgattgctttaacaagtaatcaagctcgtgtgcttgataattggtattgacggttacgagcacggctccgatctttgcagttgcgaactggacggcaagccattcagggatattagaagcccatatggcgacgtgatctccttttccaatccccatccgcatgagacctttagcggtttgacggcaaagattgtcaaattgggcgtacgtatagcggatatttaggtctggataaacaaccgcttctcgatcgggatgcgcttcagctgtttgttccagcagcctgccgattgtggaatggatgagttcagccattgcttgttcctcctttcttaatgatgggaaagcgtttacatttttattttaaaagctgtctggcgatcacgagacgctgaatttcagatgtgccttcaccgatttccattaattttgcgtcccgcagcatccgttccaccccatactctttcatatagcctgaacctccatggatttgaatggcttgattgcaagctcttgtcgccatttcagatgcgaataacttggcgtacgccgcttctttggtgaacgggcggttatggtctttcagccaggcggcttttaacaccatttgccgtgccagatcaatttccatcgccatgtcagcaagcttaaattgaatcgcttgaaaggaagaaatcggctgtccaaactgctttcgttctttcgcatatgccaatgatgcgtcaagggccgcttgagcaatgccgactgcaagagcagcgatggagattcgaccaccgtccagcgtatatagaaactgtttaaacccttttgttggatcgccgagtaagttggccgcaggcactcttacatcctcaagcaaaatttccgctgtattcgaaccgcggacgcccattttatcgtacgggctcgtaatcgtaagtcctggtgtgtcagttggcacgattaatgcggagatgatgttttttccatctttgtttttgcctgttactgcagtcacaataactgtgcgtgcgtagcttgcattagtgatccagcacttttcgccgttgattacatattcgtcaccatttgaaatcgcttttgtttgagtgcctcctgcatctgagccggcatttggctccgtcaggccgaatgatccgagtgctgtgcctgaagccagcggcgtcaaatgcgtccgtttttgctcttctgttccgaagtagtatagagggcttgcgcctagcgagaccgctgcagcatagcttaatccagtactgccgcaggctttgccgacttcttcaaccgctaaagcatatgaaatcgtatcaccgccagatccgccgtattcttctggaaatggaatacccatcagaccgagttcacccatttttttaaatgtttgcatcgggaactcgcctgtttgatctacatgttcagcgtgaggagcaatttcttttttcgcaaaatcttttaccatttcacgcaccatttgttgttcttttgtcagctcaaaattcacatcgtttcctccttcacatctttgtaacatcctattaggcgagttctataatcattccctgacaagaaaagtctgaaaattaaaactgaatcattttttatgtgataatttcagcggaatgagcaaatacatgcagtaggcgcataccatccatatcgcaaacgcaataacttggccctttgataaagccgggaatatgaggggatgattccaaagggaaatcgtatccatcaataaaccgaccgctgatccccatatacctagcttgatcaccgcgaactgtgattgatcgagtttttgatagagaaagaacacaaagcataaaacaagagcggtgcccgctcccaagagaagaaagttcggcaaaaaggcttcttcagccggatcagtcaaacagcatctccgaacagcacaaaaaataatgtggcacctaaccagactagaaatgaaaacgtaaggacaagtctcaattgatgagtaaacatgttcgatctcctttcgtgttacatcatgttttcagtcagcttcaccagcatccattcaagctcctggtagacatcttccgttgtaaaatcatcagtgacgagagactggatggcaagcccgtcaattaaagcattcagcatgattccccatgttgttaaggaaacgccgtcaattggagatgtgccccacaatcgagtgagctcttctgtcagatattgattttcggattgtaacagatgacttagctgctctttgatccgttcattttgaaatcctgtaacggtcagcttctaaattagttagttcaataactataactcttgtaattacaataatatggaatggtcaagaatgccgtagattactaaatcgacaacgcccttgccagaccaatattgcccgatgacgccaatcattttatgtactgtctttatgttatgttttgggatgatccggcagtaatcgaatactttgcgattatcatatatcgaagagaaacacgtcctgtacgtgtttctcttcgattttacttagtactagtttctcagattccaataatggaaaatgtccaaacaccgcctacagcggcttactatcgtttcctgtctccaaaatcacttttaaaaaaagacgacttagaaagccgtccttctcatttcttattttgttgttcgtttggaagccttgctttcgttatgaagccggtctgctgaagtgacataatacgtatatttcttgttgggatctgccgtgttatctaagaaggtttgctgctcatgtgtttttctttgcgttgccagcaatgttctctgctttttcccttcggctctgtatatcgcataataggctgtttctttcgttttttgatttgatgggtgatctttaatctgcagaagattgccgtttttgtcttcggtgactttcgtaagcttcggtttttttggggcggtattgtcaagccaaggcatttgcggaaccagtgccggcttgctgtaaagatcggtgctgagcctgtctttgatgccaagcggatttttgttgaggtccttgaggctgaaatgcatgcttcctttcaccagttcaagctggtagttcaaagtgatttgccgcacatattcctcaggatcggaccaaggcggatcaaaattgttattgattttatatgctgcctggccaatatataagtgaacaggcctatttttgacttcattgctccaccaatcagccagcacgtcgtaagccgctgcgttaaagccgatactccaataaatttgcggagcaatataatcgatgtcgccttcttggatccaatgccttgtgtctgcatatagatcgtcataatttctgacgcctgcttttgtattcgatccggtcgggtcatctgcggcgtttctccatactccaaagggactgatgccgaatttgacatacggttttgcagctttaattgtttggttgatttgtttgacaagctggttcacattgtcccgccgccagtcatcgatattagaaaaagcgtcttttccgtattgttcatactgtgcttgatcaggaaattcctgtcccgctattttataagggtaaaaataatcatccatatgaacagcatcgatatcataatgttttacgacttcttcaatgcctttgacgataaaatctctcgcttctggaatgcctggatgataatacagctggtttccgtaggcggcaacccaatctggatgttttcttgccgggtgatcctcagacaatttattaagatctgtatgattcattgtaatacggtaaggattaaaccacgcgtgaaattccaaatttcgtttatgggtttcttcaattataaatgcaagaggatcatagcccgggtccttcccttggacaccggttaagtattctgaccaaggcccgtaagctgacggataaaaggcatcagccgtcggtttaatctgaacgataacggcattcattcccattttttgcacatcgttcagcagtttgatatactcctgtttttgctctttcacagataacccttttttggacggccaatcaatatttaatacggaagcaatccatacggctctcagctccctgtcagactgcgcattggccataaacggaacggaaatgacaaacgttccgatgatcaagctgacaaggaaacggacaatcgacttttggcaaaccttcattctgtttcttctcccccattacatcactttcactattcgctattacggtattcccgggctttaaaagggtgattaacagaatgtctatctcactaaataaacgaaaaaagtcctaaagcatgttgtgaaccgcttttaggactttttatcattcatcatggtttgcagactttttaacacatcaataagttttacgccgacaccgacagccgtttcaaggatcgcttgtgctccggcaatggctaaaataaagatcagcggtattgcaatacgaggcaaaaaaagatagccaagtccgatcaagatggcacaccaaacaccggcacaccagtagcaattgagcatgtatccaaagttagaagccggcacgcttttttcatctacatgcccgttttgatcaacaatccttttctttttcataaaaggttttcggataaattctgtgattttgtcgaatacaatcaaatgtgtcagcctgtaactggctagaatcagcatgataaacgtaagaaaagataaatgatccatgacaagcctccaagaaaaaggatgatgttatcattccctagtgtcatcgatccattctttgatacaaaaagaagcggacagagaatgcctctgtccgcgaatccgctctattgtttgtgcgggattgctttatttgaagtgatcttttctaaaatgtctaggatgatgtcagcattcttttcagcatatgttccttccagcatgtctttatgagcgccaaaacccgtgtactcactatagtttccacaggtgccttcccatttcgttaagcttgtatgcccgctggtttcggggtggattccagcttcgatgaaatgaatgcttgctttgatgtgcccttcattcagcaattgtgcccaatatgcctgatagtttctttttttcttcatcaccttttctctgactgcttcaggcagatatgctgcagattcgtcatttccggtatcgataggcaaaggctgttcttttagataagcgtccacgataatgaaatcgctgacttccaatcctttgcgctccatagcctgtgccacttcaaaagccaggtttccgcctgcagagtagcctaataaaacgtatgggccctcaggctgtatgtccgtcatgcaattaacatattgttcaatgcgggtgtcttgttcaataaagtgaaacccgtatacggctgccttctcattcagcaataaagcaagatctttaaaataaatgccaaatccagatatcggcgggaagcagaaaagattttgcgcgccgtgctggttcagtttgatcacatgctgttcatctgtcgctctcagctgtttagaataaagtttttcggcaagctgagcgattgtcggatgttcgaacaagaaatcaatcggtatgtcaatgttctgctgatgttttagtgtatgtatgacttgcagtgcttttagtgaatgtccgccaatagcaaagaagtcatcatcaatactgattgtgttaacaccgaggacttgcttccaaatgttcgccaattcttcttcaaccaagtttcttggcaatatgatgtcctgtcgtttggcagacttattttctggaataggcagcgcgctgcggtctatttttccgtttccggtaagcggcatccgctccacacgcacccagtgctgcgggatcatatagtctggaagcacacgcgccaaatcggcgcgaaaatccgtatctgtttttttgtgatcgccgacgtaatgagtgtacagctgcgcctctccatctttttctctcaatgtcactgctgcttcttgaacgccttccatttctaacaggcgcgcttctatttcggcaggctcaattcgttttccgcggattttcatttgcctgtcaattctgctgatgtattctaagtttccatcaggcagccagcgcgccaaatcaccggtacggtatattctttcaccaggcaagaaaggatgaggagaaaaaacagcatttgtcaggtcatctctgttcaaatagcctttagcgacaccatcaccgccaacacaaagctcgccgggaacgcctattggcaaaagacgtccttttgtatctaagatgtaagcggtgctattgctgattggttttccaatcggaatcggccccgcatagtctctcttcatttcaaaaaaggttgaaaaagtcgtgttttccgtaggcccgtaaatattatgaagcgcgagatctggacaggcgtgcctgacggcattcatcagggcaggagagagtgcttctcctccgacatataacgtatggagtccgcgaaacatgtcagctcgtacctgtgccagctgattaaaaagagccgtcgttaaaaatagcactgtgatgtcattttcaagcaaatacgctccaaaccgatcaggtgacagcattgtcgatttatcaatgatatgaaggcttgcgccatttaaaagtgccccgaacatttcaaaggtgacggcgtcaaagctgatagatccagtaagaataaaccggtcatcaccggacgcagacgtgtaattgctgttgctgacaagggacacgacattgcgattcgtgatcatgacccctttcggccggcctgttgatcctgaggtatacatgatatatgcaagatcatctggactggagctgctgttgataggaaaatgattctcttccatcaatgcctgcgcatctgcaatcatacatgttcctgagaacgcagcattttgctccaatcccttttgaacaatcagcatttttgcttgcgtttcctcaagcataaagctgactcgttcaggcggaagctccgcatcaagcgggaggtatgctccccctgcttttaatacggcaagcacactgatcatgaattcgggagaatgtgcagccaatattccggctgtctcgtttatccgaaatcccttttgaattaactctctggcgagcgcattagagtgtttatcaagctctttatacgaaatagacatattgccatacacaagtgcggtatggtctggcgtcttttctgcttgttcgcgaaataaatccataattgtatgattctttggatactccgtttttgtattgttgaactgtgtgacaatctgctctttttctgttgcatcaagaaaagaaaaatcagcaattggcatatgagggtgctgtgccgctgtgctaagcgcttgcgtaaattgcctcttgatacagctgatccaggcagcatcgtaaacaaacgcattatagctgaacttgatgacaagctcttcaccgggagcaacgacaagattaaaattatatcctgattgctcggatacttgaacttgatcgatttgcagcggtgaatcggtttgatcagcggaatcggcgattttctgctgtaacggatagttttcaaagacgataatgtgatcaatcagttcctgttttaatgcggtgtttgcctgaatatcaaataaaggttggcagataaacggctcagcttccagcatttctttctggcagcgtatgagcagctcgtgaaacgtttcgtcttgatgtgttttaattcgaatcggtatggtattgataaacaaccctatcatttgctccacgcccgggatttctgacggtcttcctgatacaactgcgccaaacacaacgtcgtctgtgcggttatattgctgcagcatcacaccccagaccgtctgaataagggtagcgagcgtgacgccatgttgtttggcagtctctttgagcttgtctgtcagtggtttatttaatgaaaatatcaaatcttcacggtgataaccttcttttgtttctttatcagacacacgaggcagaggtgatggagtgctgtagttttttaaataggtatcccagtaggccgctgctttttctttgtctcggtttgtcagccaggaaatataggtgctgtacggacggacagggtctaatgaaagcggctttcctgcatgaatcgattgataaatttgcataaattcctgcataacaatacctaggcaccatccgtccattaaaatatgatggtgactccagatacagacatgctcatctttagctgttttgaatagagaaatccgcatcagcatgtctttttgcagatcaaagcctttttgcttgtccttctccttaaagcgttcaatatactcattctggtcgtttgttggcagatgagaaatgtcttcgctgtacaaatggaattcacgttctgtcatcacgacttgccgaggtcccgacaaatgcgggacgtgcggcaaaaacacagttctgaaaatatcatggcggtcgataatggcttgaatgctgcgctgaaaccattcatagctgaggcttcctttaatggtgaagagcgactgctcaacgtaagccccctcctctttacggaggaaggaatgaaacagcatcccctcctgcatgtgactcagaggataaatgttcttgatttttttaatgttatccatagtgtctgcacctttcttcacggattcattagtgaaaactgagcatatcagcgatctcttgcagcgcgtcctcggtcagttcttgatcatcataatcactgatcgtcttttctgtttcgcttttgttctggcagtgttcgatcagttgtaataaaaattgacggcatgtttcgctaagctgttcgatggttttgcgctgaaagcgggcattgtcataagtcatattgacagtcaattttccttctgcagcgattgcgctgatatccagcgactgttcacggttccatgttgtgctgatatcacctccggcacccagcggagagaatgagaaggtgtcctcctcaggtacttcagctgtgcggccgctttcaaattgaccaagataattaaagctgatttctggtgcacctgtgaaatcgatgtcttttttgccaggcggagtcaaatatttgatgacaccgtagccgaatcctttgtcaggtacacgtctcagtgtatcttttgttgtttttagcacatgaaccatgccttcttccgaatctggcaagtctgcgttcagtttaatcaataacggataaatggcggtaaaccatccaatcgtccggctcacatctattccttctaatacatcctctcgcccgtggccctctaatgatagtttgaaggcggattgattggtccaatggcgcagcgcaagaatgacagaagcgagcagcatgtcctgcgtatcagtgttgtatgcgttgttggcgtcttttaagagtgctgctgtctctttatcgtttaaggtaaacgaaattgtggaccgttgtccctcgtgtgctctagttccatcgatttgatcaaaaggcaatgcctttgtttgatactcttcggcttcgcgccaatacttgagctgtttcattagctgctggctttcagcgtagtcagagagctttttcgcatacgctttaaacgagcttgttttaggcggcagtttgatatcctccccgccagcagcttggcgataccctaaagccaaatcttcaagcagaacccgccatgagatgccgtcaacgacgaggtgatgagcagataaaaataagaaatcaccgtcaattgtgtggaaaagaccggcttgcagcagcggaccattcttcaaatccattttctgctgaatatcaagtacatggcgtttgataataggctcatacgctctatttccatcagtgcataaatcaatcatctgaaggccgtacaacgcgtcgtccgaatgactgagcggccgattatattgagcccactttccttgttcattctgtgtaaacaccattcgcagcgcatcatgatgacacgttattgcttttaacgtttttcgcagtgcgtcttcttgtacagaggtgcttcgatgcagcattacggactgattaaaatggtgtttttcttttatatcttgagaaagaaaccatttttgaacaggcgaccattgtacgtctccctcaaccgcagcttggctggaacttgtatctgaatctcggatataagctgccaattcttgaatggtcggatggctaaacaaatctttcactgccatttgcttgcctatccggtgaagccgcgcagatacctgtaacgctttgatcgaatctcctccaagctcaaagaacgaatcagctgttccgattttttctgcacccagtacatccttccatatatccgccagtatttgttccattttgctggctggcgggaggaatggacgttcaccttcgcgattgtgtacaggtcttggaagtgctccgcgatccagcttgccgtttggtgacaatggaagtgagtccagtttttcaataaacgcagggtgcataaacaccggcagcttgttttgtaattctgaacgtacagcatttgtgctcaactctggttttgtcaccacataagcacttaattcggtttgtcctgacgctgttacatgagcaactactgcggcgtcttttacaccatttatacatcggatgaccgattcaatttctttcgtttctacacggtatcctctgattttgacttgatcatcgattcttccgagatattcgagtgtaccgtcggccatccatctggcggcgtctcctgttcgatacattcgtgcttcgggtttaaatggattctgcgtgaatgctctctctgtcagttctggaagattgacgtaccctcttgcaagccctgttcctgctatacaaagctctcccgcaacaccgattggctgaagctgatgattgctatttaaaatcagcacttgagtcccgtcaatcggctggccgatgcttacgtatgcctgcttttccatatgtctcatgacggtagtcgccacgctgttttctgtcggtccatattcgttggcgagttcggtatgcggacatatagctaagctgaggtcgatcaattcgcggtcagccgcttctcccgccagtgtgacgactctaagcgtctttacatcttccggctgcactacgtccaaaagcgctcgatataaaacaggcacaataatcatatgtgtaatccgttgacgagacagctgatgcttaatggtcagaatatccttcgcttcctcttcatgaagcaaaacggcttttgcacctgacaaaagcggtgtaaacatactagttataaagccgtcaaatgagaaagaaaagagctgcagaatggtatctgtctcgttgaatgcataagcgtttctccgccactgaagagtgttggcaatacctttatgctcgaccattaccccttttggacggcccgtcgttccagaagtataaatgatataagccaaatgatgggcagacgacatttgcggcagcggcgatttgtcgtcttcctctacgctttctatcgtcaagatctctccttcaaagtcagcaattactccccgatccgcttcatttattgtcatcagcagtttcgttccgctgtcgctgaggatatagcgtttccgttctgtcgggtattcaggatcaatgggaacgtaacagcctccggctttccacacaccaagtatggatgctatcatactgaacgaacgatgcatcatgatgcctactggtgtgtccggcttaacacctcggctgcgcaatgcacgtgcgattccattggaccactcgtccaactcttgatacgtcagtgttttgtcttcgctgacaagtgcagaagcttttggtgttcgtgcagcttgctgctcaaacaattgactgattgtttgaactccgtattgattcgcttgcccggtgttaaactcattaagcagctggtgccgctcttcttgggtcaggatgtcgatctggttaagtgtcacctccgggtttttaccgatgatgctaagtacatttgttaaatgcgatgcccagcgttcaatggtggttttctcgaacaatgcggttgaatattcaaaaaggaaatgaatgtttccgtcgccctcagatgcctgtagtgtcaaatcgaatttagaaacgagatgagaaacttgtgccggcttcatttgcaaatcatgaagatgcaatggctcgtaatcattattttgaacaactaacatcgcatcaaacactggatttcggctcatatcccgtgtcaattcaagcttatcgacaagttcttcgaacgggtaatcctgatgctcaaaggcttccaatgctgtctcacgcacttcctgcaaatactgtacgaatggcttcccgccctccgggcgcgtccgaagcgccagcgtgttcacaaacatgccgagtatcggctcaagatccttgtgcggccggccggcaattggcgagccgacgatgatatcttcctgtccgcttaagcgtgacaagaacgcggtgtaagccgcaaggagcaccatgtacagtgtgcttccgttttctcgtgccagcttgtgaaggcctgatgcaacctctggttccagcgtaaatgagaccttgtcacccgcgaagcttcgcaccggtgggcgggcatgatcagccggaagatccagcacaggcagctcgccctcgagctgcttcagccagtacgtctcctgcgttttgtacgcgtctcctgttttgaattcttcttgccatacggcgtagtctttatattgaatgcgcagcgcaggaagattccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgtggcctcctgttcggttcgtgcgccgagaactgtagtctgtagcgtaaacggcgcctcgtcatggatgcgctgcaccggatcgcctcctgcgtcctgttcgaaggaggtccgaagcgactcatggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgccaggagctggcagggcgtttcggtcgagctttccgcttggcgtaaccggccactgttccatctctatcatataggctgggaccatgtagcccggcaacagtctctcaagctgcgctcggatttcgtttctttggagcccttctacataagcgcataattccggctcgccgctgtctgtccgtacggtaacggccgcctcccttacgccttttatgcttcttagtgccgcttcaatttctcccggttcaatccggtagccgcggattttcacctgatcatccgtacgcccgagaaattcaacattcccgtcagggagccagcgcgccacatcgccggttttgtacatgcgttcccccgggtaaaacgggtcttcaagaaaacactcctccgttaatgccggccgattcaaataacctctggcaacacccgctccggcaatgtatagttcgccgatacatccaacaggcagcatccgctgattctgattcaggatatataatctgacatgatgaacaggttttccaattggaatccgttcaagtttttcatgtggcggacaatcaaagaatgcagcttctacggttgcttccgttggcccataggaattggttattgaaacatttggaagcaactcgtaaaatcgggagacaagatgggtccccagctgttctcccccagaaaacactcgcttgagtctgtttgtcttaatcggtacagagcgatattttatatgttctaaaaatgcatggagcattgaaggcacaaaatgcatagctgtgatcttttgttcttctatggccttcacgatcacttcaggttctttttcgcctccctgaggaagcagataaacagaagctccggcataaggccaccaaaacagctcccatattgaagcatcgaatgaataggatgttttgtgcataatcatgtctgaatgctttagctgatagcgggactgtagggaattcaaaaaattcaccgctgatcgatgttcaatttcaacacccttaggcatcccggtagagccggatgtatagatgacataggctaaagattgcgggagaacgttcacattcggattggacaaacgatgtgccagtccgctatttgtctgattgagatagacaatctctcctgtaaatgccggaatatgaaggctggcagactgaagcaggagaatgtttgtaccgctgtcctccagcagaaagctgattcgttcttccggataatccgggtcgatgggcagataagcgccgccagctttaagaatgccataaatgccaagcagcatttcaggtgaacgctttcctataatggcaacagtcgtttcgggttttaccccccgtccaattagctcccaggcgatacggttagcccgttcgttcaattctttataggtcatcactccatcttcgaagataacggccgcctgatcaggcgtttttgctgcctgctgttcgagtgcatagtggagcgtttgattcattgaatagcccgtctcctcatacggatggcatgattcaatgaaatctctctcttcttcttttgttaagattggaatatcgtccaattctgtttcagggctggcagctgtatgttccacaagcgtggtgaaaaggctggcccacctttggatggtttctttctcaaacaaagctgtactgtattcaaactgacagaaaagctcggaatcatgctctgtaacgtatagggaaatatcaaattttgatattgggtgctccaagtcgttccactgaagctgtacatcattcatttttagcttttgctgttccatattctgaaggactagcgttgtgtcaaacaaaggattccggctcatttcccgctgcacaccgagtttgtccacaagctcttcaaacgggtaatcctgatgctcatacgcttctagtgccgtctgtctgacttcttttagaaattcctcaaatgtcttattacccgccgggcgtgtgcggagagccaatgtattgacgaacatcccaagaacagcttcaaggtcggcatggggccgcccggcgataggtgaaccaatcacgatatcatcctgaccgcttaaccgagacaaaaaggctgaatacaaagcgagaagcgtcatataaagcgtgcttctgtttttatgggcgagccgctttatgcgggccgtgatctctttgtccaattgaaaggttacttttccgcctatgaattgccgttctgccggacgtcgtttatctgttggaagctccagtataggaaggtccccgctaaactgctgctgccagtaagtctcctgcttttggtacgagtctccctttttaaatttctgttgccatacggcgtaatctttatattggatccgcaatggcttaagctgccggtttgcataaagatcggtaaattctcggattaggagctgaacggatacgccatctgaaatgatatggtgcatatccaccagcaatacatgcttctcgtttgacacttctataaggcctgctctaaataatggcgcctggctgagatcaaagggacggacaaatccctcgatagtggtctctttacttaacgtaaacggcacttcggtgtggatacgctgaaccggctcgtcatcagctccggatacaaaggaagttcgaagcggctcatgccgattgatcagttctttacatacagcagacagtttggcgacatccagtgcaccttccagttctaagaccgcaggcatgttataggcgacaccctcatcaagctgttgaagcacatacattcgtttttgggccgaagatacaggatatgtacccctttcttctgctggttcaattgctgcatacggattttgttctgcctctcgaatgattgaagctaatccttcaacagtcggatgagcaaagatgtccttaagcgaaacttgcacatggaattcctttgcgatccgtgacataagcactgttgcttttaacgagtggccgccatggtcaaaaaagttgtcttggatgcctatatggccattattcagtacatcttcaaatagttgtgaaagctttgcctctaacagatttcgaggggcagtatatgggtttccgctgattgaagcatctggccccggaagtgctgcgcgatctacttttccatttggggtaagaggtatgctgtcaacccatatccatttcgccggaatcatgtattctgggagctcactagccatataactgcgtaaatctattgcgttcagcttttgtacactgcaatagtaagcgcataattcatgttcaccgttttgatcttgccagatgagaatggcagcctcactaatgtccgggtgattcattaacgtgacttcgatttcttgcggctcaattcgataacctctgattttcacttgattgtctgcccgtccgatatattcgatgttgccgtcttcaagccgtctggccaaatcacctgtccggtacatgatcacaccaggcttgaatggatcggatgaaaatttgtcgcttgtcagtttatcgtgattgacatatcctctggcaacacttgcgccggaaatatagagttcgcctggtacgccgcatggctgaagctgtttttgatgattcaaaatatatagatcagtacagcctatcggtttaccgattggcggaagctcaggaatagggtctccaggatgaatggtatacgtagataccacatgagtttctgaaggtccgtaatgattgtgcaggtgtatgccgcgttcacgcaacacatcttggaaaaggtctgaaatcattaattgttccccggctgcgatcaggtgtttgacgccatcaggaaacgagttcgcaagttctcgctcgctgaaaatcattttgataaaagcagttgggagaaacacaatattcgtctgatgcttgtttataaatgcaaacagctgaggcacatctctttttatggcttctggcacgatgtggagtgtgccgcctttcagaagcgcagaaaatatttcttgatagcagacgtcgaaggaaggtgtagcaaattgcagaacatctgcttcaaagtcaatgccggagtgagtatattcgaacttcagcaagttagccatgtttcgatgctcaaattgaacaccctttggtttacctgttgtgcctgatgtataaatcatatacagcagatcgtcagcattgttgactgactttatgttactgccgtctactttgctttcgatatcttctggatgagtgataatgtaattgtcttctaacgatgaggaaaggtgcgcttgtgaaacaacatgcgaacagccgcaatcatgcagaatataacggattctgtcagccgggtaatgcggatcaaccggaacaatggcgccgcctgcctttaagattccaagaacgccggtgataaacgccgcagagcgttccatcataatcgcaacgggttcctgtctcacaacgcctttcattcgtaaatgccgtgccaatctgttagccgctttattcagttctctgtatgttaatgagcaggcttgatcaattacagcatgagcatctggtgtcttttccgcttgcttttcaaacatggcatggatggtttcgtaaactggtgttcgatctgtgatttctccaatcagctgccgcttttcagtatctgtcgtgatatcgatttcttcaggtggaagattcggattatttaagatttgcgatacagcattcagaagatgctctttgacagagagcacaaaagaccgatcgtgctgctccgcatcatagttcattttgatatgaatttcttcccctggcgccaccataagataaaagctgtagttggtttcatctgcgacagtgaaattatgaatctgaaaaagatcagaagcatgttcctgtttgttcagcatttgaatctcttgctgcaccggatagttttcaaatacgagaatatgatcaatcagcccttgtttaacagctgagcgggattgaatctcatataaaggatggtagctgtacgcttcagcggcaagacggtctttttgcatatcttttataagttgaagaaaaggcgtttttgccccctgcacccgaaccggcatcgtattaatgaaaagacctaccatatgttcaatgccttcgatttctgcgggtcttcctgaaatgacagaaccgaatacggcgtcatcgttattattatatttttgcagcagaatgccccaaatggtatgaaaaatcgtactgagtgtcacttcttctctagcagcaagctctgaaagcctgctgctttcttccttagagaatgaaaatgtaacgtgttcctgcctgctttttccctttgtttttttctgcttcgggagcacggtttgctgttcgtggccggaaagataatggtcccaataagaaaccgcctgctctttgtcttgctccatcagccatttgatatactttccgtatggctggaccggctccaatgttattggggatgcatttacataagatgcgtaaatatgcagaaactcctttagcacaatgctgaggcaccaaccgtccatcatgatatgatgaaaggtccaaatgcaagtgtactggctctctcctgtttgaataagagcgatgcgcatgagcacatccttttgcaaatgaaacccccggtcccggtctttttctttccattgctcgataaactgtgattgctccgcctcgtttagatgagtaatgttttcttccagtacgatgacatttcgttgtctcagaacaacctgctgaggagaggaaacattttggctgataaaaatcgttctgaaaatatcatgtctttctacaagagcgttgatgctgttttgaaaaaactgcgggttgacttttccttctattgtaaaagaagcttgctcaacatacgcctgtgaatctttttgcaggagggaatggaaaagcatcccttcctgcatgtaagacagcggataaatatcctgaattgaattcgcttttgtcatgttcatgtctccctgtcacgattttctacaattcttccaccaagctggatatgctgtccaagtcctctgccgttaatgattgactgctgaaatcgctcagtgtcttttctgctttctgttgaccggcgcagtgtttcataatgtccagcaaaaagtgttcaatcctgttaataagctgctccattgtgtttctgtgaaagcgggctggcggataactaagattgaaatggagctttttgtctgctgccattgcgctcatctcgataatttgctcgcgcttccatgtatgagtgatatcctttccgctaccaaggcttgatgggcggaaggtgtcctgtctttcgatgtcgttgaactggcccaaatagttaaagctgatttcaggtgtttttgaaaacgtaatgcttttattttcagggtgtgtaaggtatttcagcataccgtaacctacccctttgtttggtatccggcccagtgtatctttaacggtttttactgcggttccgagctcatccctatgattttcaaagcttatgagggccggatacatggatgtaaaccagccgaccgtcctgctgatatctaactctggcagaatgtgttctctcccgtgtccttccatagcgatacggagcttacttcctcctgtccattcacaaatcgccaaggatgctgcggttaacagaatatcttgtgtatctgtgccataggcgtaattgacgttttgcagcaagacggcggtgtctgcttcagtcagtgaaaagcttaatgagtcccttttgctggagtcgatgttcagatgatgcggtatttcatatggcagttctgcggcttgctgttcttctacacttcgccaatacgcctcttcgcgaatcagcttactgctttgggcatattcctgtatgcgtcttgcgtattcctgataggaatcagttttaggcggaagctggatcgtctggccagcagcagcttgttgatatcctgctgacaaatcctccagcaaaatccgccatgagacaccatcaacgataaggtgatggatcgcaaggaacaagtaatctccggtcagtgttttaaacaaagcggcgtgcaacaatggtccttcctgcaaattgatgctttgctgaagatctgcaacttcttgtttgatttgcgtctcccagccgctttctgactgtgaaagatcagaggttcttaagctgtatagctgtgactcatgaatgccttggttgatttgaatccatcgcctgccatcgttgcgataaaccatccgaagcgcatcatgatgctccgccagttttttcaaggctggtctaagggcgttttcagacaaacgtccagaatggaatagcatgacagactgattgaaatggtgtctttcttcaatatcttgtgaaaaaaaccattgctgaacaggcgtccaaggaacgtctccctgaacgggtccttgctctatgattctctctgacttacggataaatggtgataagtcctttatctttggatgacggaataaatcacttacctgcaagcttagcccatagcgcccaaggcgtgcagaaacttgaagcgctttgattgaatctccgcccaattcaaaaaacgaatcctctattccgatcctctggatgccgagaacctcctgccagatcaacacaagttggtcttcaaggtcatttcgaggcggagcgtacgtttgtttagatgtgaaatttggttcaggaagtgcttttcggttcaatttgccgtttgatgtgagcggaagagtctccatttcaataatgtacgccgggatcatatagtttggcagcgaacgcgcgagaagtgaacgcacttgttcagcattcgtgcctgcttttacgctgatatagccaaacagctctttgctcccggtctgggctgtacgtgctaacactgcggcttctttgaccccgtctatttgacgaagtgctgattcgatttcacccagctccacccgatagcctctgacttttacttgatcatcaatacgcccaacgtactcaattgtgccatcaggaagccagcgcgccagatcacctgtgcgatacagtcgatcgccaggtgcaaatggatgtgggacaaatttctctttcgttaaatcaggacggcccaaatatcctctggcgacgccatctccgccgacacaaagttcaccgacagctccgaccggctgcagcactccccattgatttaagataaaagcggtggaattaccaaccggccgcccgatcggaatggaaagttcatatgttttttgaatgtgaaggcatgtcgaaaaagttgtattttcggtagggccatatccattccatatagatacttcagggcagacatttctgattcgattgacgtggctcggcgacaaagcttctccgcctataatcaaatgtttcagctgtgaaaatgtttgttcattttgttctgtcaaatgattgaatagagaagatgtcagccaaatcgttgtgattccttgatgttctatgtacctcttaagctgatgggaatcgagaaatgtttgttgatcggacagatgcaaagcggcaccatttagcagcggtccgaaaatttcaaatgacccaacgtcgaaaccgattgatgatgtcataagaaggcggtcttcaggtgtaaatgtaatataattgctgttttttacaagacgaattacacttcgctgctcaatcatgacaccctttggtttaccggttgatccagaagtataaatgatatatgcgagtgaatgtggccctgctgaagaatcaacgttcttcgtttttccttgcttttgaatatcttcgattatgatttgttcacattcaatgtctaatagttgtttttctgttttttcagattgaaggagtaatgccgccccgctgtctgacagcatataagctattcgttcaacaggcagatcagaagcaataggcagataggctccccggcttttagaatgcccagcattcctgcaatgagttctggtgttctgcctgtcaacaaggctacaacactatcaggccctacgcccttaatctgtagaactgaggcaatttgatttgcccagctgttcaggtcctcgtaagtaaatacttgggtgtcgctgacaattgctacagcattaggcgtttgttcagcctgcatttcaaagagtctgctgatggtttcatttcttggataatctatttttgtacgattgagctcgtggataaggtaatgggtctcatcctcattcaggatatttattgttccgagagcggctttgttgtctttgatgatggagagtaacatattgatgaagtattgaagccacttttctatcgtttttttcttatataagtcagtactaaactccatttggaacgtcagcaaaccgtggagctgttcctgggcatatagggttaaatcaaatttggacgtttgatgcccattgtttgctgcaggtttgagacaaagttcatccagctccaacgattcctgatccatgttttgaagaacaaacattacgtcaaacagcggatttctgctcatatcccgtgtcaattcaagcttatcaacaagctcttcgaacgggtaatcctggtgctcaaaggcttccaatgctgtctcacgcacttcctgcaaatactgtacgaatggcttcccgccctccgggcgtgtccgaagcgccagcgtgttcacaaacatgccgagtatcggctcaagatccttgtgcggacggccggcaattggcgagccgacgatgatatcttcctgtccgcttaagcgtgacaagaacgcggtgtaagccgcaaggagcaccatgtacagtgtgcttccgttttctcgtgccagcttgtgaaggcctgatgtaacctcttgatccagcgtaaatgagaccttgtcacccgtgaagcttcgcacaggcgggcgggcatgatcagccggaagatccagcacaggcagctcgccctcgagctgcttcagccagtacgccccctgcgttttgtacgcgtgccctgttttaaatccttcttgccatacggcataatctttatattgaatgcgcagtgccggaagcttccgattattgtacagttcgccgaattcccgaatcagaatgttgacggaaacaccgtctgaaatgatgtgatgcatatcaaccagcaataggtgccgctcatctgatacctttacgatttgggcacggaacagcggcgcttggctgagatcaaacggtttgataaatgcggctgcggcctcctgttcggttcgtgcgccgagaactgtagtctgtaacgtaaacggcgcctcgtcatggatgcgctgcaccggatcgcctcctgcgtcctgttcgaaggaggtccgaagcgactcgtggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagccggttttatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgtcaggagctggcagggcgtttcggtcgagctttccgcttggcgtaaccggccactgttccatctctatcatataggctgggaccatgtagcccggcaacagtctctcaagctgcgctcggatttcgtttctttggagcccttctacataagcgcataattccggctcgccgctgtctgtccgtacggtaacggccgcctcccttacgccttctatgcttcttagtgccgcttcaatctctcccggctcaatccggtagccgcgaatttttacctgatcatccaaccgtcccaggaattcaatattcccgtcagggagccagcgcgccacgtctcctgttttgtacatgcgttcccccgggtaaaacgggtcttcaagaaaacgctcctccgttaatgccggccgattcaaataacctctggcaacacccgctccggcaatgtacagttcgccggcgacaccggaaggctgtacggctaaatgcggatctaaaacatacaaacgcgcaccgggtacgggcttcccaatcggaatccgcaagcggtccctgtcccgttctggatccaatacgtaaaatgccgcgtctaccgttgcttctgtcggcccgtagccatggattaatgatacctgcggcaatacagaagcaaaacgggctgccgtacgcggcgcaagcggttcacctccggcgaatacacgctttaggtttgtcccgtcaccgagcgctaacatttccgcttgatcgagaaagctgttcagcatagccggaataaaatgagccgttgtcactttttcctgatgaatggcttgtacgatcaacgcggggtctttttcccagccgggcggaagcagatacgccgaagcaccggaaagagcccaccaaaacagctgccacacagacgcatcaaaggaaaaagaggttttcaccatgacaatgtcatcttccgaaagcggaaactggtactgcatgccggtcagaaaggaaacagcctggcggtgctcaacggccactcctttcggctgcccggtagagcccgatgtatagatgacataggcgagagatccgtcgctaacagaagcagacacatgacgttttacttcttcacgatcaagagatgtcatgtcaacttcaagcgtctctccagaaaagctcggtgcggagcatcccggctgtgtcagcaagagtgatgccccgctgtctttcaacatgtagctcagccgctcttccggatacgcaggatcaagcggtaaataggcccctccagccttcaagacagcaaggacagcgatcagcatgtcaggtgagcgttcggacaggacaccgacgatactttcgtttgtgacgccgcgtgccgcaaggtgcgcagccagccggctggcgtacatatcaagctcagcgtatgtcagcgaaccgtcggaaaatcggatagccggccgctccggtgtgactgccgcctgtcgctcaaacagaccatgcaaggttggggcttcaggtgaaacagatactgtcctgttattttgagaaacgattttccgtgttttgtcctcatctagcaatgtcatctttgacacaggaagagatggatcagagatgacgtcagagatcatgtgctgtaaataatcttttatttcagacatcatatttggttgataagcgcctgtatgaaaatgaatccgaacgtacaaagtacgccctgggatcactttgacactgcatctataattagttacctcttccatctcaaaatctttcacggagaaatcaaatgatccagcttgattcagctcttcaatctcttgttgagtaggtgtattttcaaagacgataatatgatcaatcagctcttgtttaagagcgctctgcgcctgaatgtcatataaagggaagtaactatacgcttctgcttcagtcatgtccttttgcattccactgactaggtcagaaaaagacagaaaatcactttggactcgaataggaatggtattgataaaaagtccgaccatgttttccacatcttttagctcagaaggtctgcctgatataactgatccgaacacagcatcgtcgcggcgattgaacttttggagcatgattccccataaagcttggaaaacagtgttaagtgtcgcaccacatgctgcagcgattttctgtaattcggaggtttctttttcaggaatggtaaacgtgatctgttgtaatgtcccatccgacatttgatctgttcttttaggcagaggcgaagctttttcgaaatgctgaagcctctttttccaatactcagctgcttcttcccggtcttgctgcatcagccatttaatatacgtcccgtacggctgtacgggaggcaaattaggaaactgcccttttccaagcgcttgataaatatggagaaagtctttaatgacgatgcctaaacaccagccatccattaaaatatgatggtggctccagatacagacataatgatcaggcgcccattttaaaatagatattctcatcagtacatccgtttggagatcgaagcctttggatttatcctgctctttgaatgcctctgtacaatgttctttatctttttcattgagatgagaaatgtcttcaacatgaacatggcaatgacgttgcttgagcacgacttggcgaggtttggctacatttttatagatgaatgctgttcgaaagatatcgtacctgtcaaaaacagcatccatacttttctgaaaacgctccaagtcaagctgtccatggatcgtaaaagaagcctgttcaaaataagctctcgactgttcatcatacagtgagtgaaaaagcatcccttcctgcataaatgacaaagggtatatatcctgtatttcgggttgctgcggcatcagtgaatctcctctccctatagtttgttgacggctcccataatctcactcaattcatcaagcgttaagtcttcatcagtgaaatcagatgcgctccattctcggttttctttgcccgtacaatgctcaatgatgttttccagtgtctgtttaaaatgcccggcaaatgtttggattgttttttcttcgaattgcagcctgttatagatgatgtgcatgttcaggcaccccgaagaaacggcgccgctgatatccagtgcataaggacgctcccagttcgggctgatctcatttcctggcttgatgtcagacacctcaaaggcatttgattgaatatcctgatcaaactggcctaaataattaaagctgatttctgggctgtttttctcagagccccatcttttgctgatatatttcagcacgccgtagcccgcgcctttatgcggtatacggtgcagcatatcttttgtctgtttaataaggtggcccagccgctcttctttgtccttatgatcggaatctctcatatcaagccacacaggataaatggaggtgaaccagccaacagttctgctaatatcgatgtcctcaagatatgattcccttccatggccctccatgctgattttaaattggttatttcccgtccatttctgcaaagcaaaacctaaagctgtcagaaggatatcattcatctccgtgctgtaagctttatgtgcagccgttaatagtaattctgtgtgatggcgagatagctcaaaatcaatcacttctgtatctatgaatgtgttagatgctgcgtcattgtcttttggaacaggctggatgtgacggttctcgcactcatcccagtacgctgcttcgcgctgcatctggcggcttttagagtagtcaactattctttgagaatacgttaaatatgaatctgttttttgcggcagtttaatagattctcctgagactgcctgtttgtaagcagctgaaaaatcctcgaacaaaattcgccaggaaaccgcatcaacaactaagtgatgaatcgtcagaaataaatggtcaccattctcggttctaaacaatccagcatgaagcaaggggccggtttccaaacgaatatgttcttgcatccggctggctgcttcctcaatcgtgtaccgtgcttctgttaggctatcctttacatcaaacagttcaagtgcatatagctcctcatctgaaagatctatccctctgtttatctgcacctgcctgccatcttcatgccggcatacgattctcagtgcatcatgatgagtcacaaggctttttagtacttttctaagcgcagcctcatcaaatcgttcagcccggtagatcataacggactggttaaaatgatggctttccagagattgcgagaaaaaccactgctggataggtgtccaagtaatctcgccttcgaccgggccttggtcaatggcgcgtacgtcttttcgaacccgggcggacagttcaccaagagtctgatattcaaacatctcacgtactgtcgtttcaaatccgcgctgcttcagtctggcacaaacctgcagcgctttaatagagtctccgccaagctcaaagaaattggcgcctacacccaactcattcacattaagaagctcctcccaaatttcagccatcaccgtttcaatctcatttctaggactgatatcatcagctgtataagcgtgtttttcaggttctggcagggctttctgatcgagctttccattaacagtcaccgggatgctgtcaatttgtatcatacgggcaggcagcataaagtcaggcaaggcgttttttaggtaagcccggatgtctgatatattcgcagcctgttgatctcttatcaccatataagcatatatagctgtttgcccttgctcgtctgctctggtaatgacagccgcctctttaatcattggatactgaagaagtgccgcttggatttcgcctaactcaatacgatgccctctgactttcacctgctcatcaatgcggcctaaatattccagctcgccatttgacaggcgcttagcaagatctcctgttcggtataatctgtctcccggaagataaggattggatacaaaacggtcagcggtcagctcatctctgttgagatatccccgtgccacaccttcgccgcctatatacagctcccctggaactccgataggctgcagattcatatgagcatccatcacataagcctgcagagttgaaagcggccggccgatattgcttttattttttgcaatgtctgctgcggacaattttttgaatgttacatggactgttgtttctgtaataccgtacatattaatcaaatcagtgtgaggatatttttcattccagctttgaagcaatccgggctgtaaggcttcgccgccaaaaatcacgtagcggatgcttaaatgatctgtatgattttgatcttcaagcatcaagccgtaaaaagcagtcggggtctgattgagtacagtgacgcgctctttttttaacaataaacggaatgcataggggtcacgggctgtttctttagagaccacgactaatgtacctccgttcaataacgcaccgaacatctcccatacagagaaatcaaagcaataagaatgaaataacgtccagatgtcttcatggttaaattcaaaaggcaggttttgatgcttcaagagactgatcacattgcggtgctcgacaatgactccctttggctgaccagtcgttccagatgtgtatatcacgtatgcgggctgatccgttactatttcttgaatgtttacatcagccggaattgagtcgttttcacattcatcgatatgcataatatgcccggtgtagtctgcaggtttgttttgaccgcgctctgtcagcagcagttttgctccgctgtcattgagcataaagctaatacgctcctgaggatattcaggatcaatcggcaaataggccccgccagcttttaaaatcgataaaatgccaatgatcatatcaggtgaccgatcgagcatcagaccgacgatatcgccagttctgaccccttgtttgatcagcatagcagctgcccgctcggctttttcattcaggtctcgatacgtaagctgagaatggccgcacaccactgcgatatgctccggatactgagcggcttgcttttcaaataagcttactatgttttcatttctcggataagccgcatactgccccattttttcaaggagcaacctacgctctgcagcaggaagcaattgcacgtccgaaattctcatctcggtatccgccattacccctttcaccaattcaataaaataggatgcccaccgcgtaatggtttcttcttcaaaaagagcagtgctgtattcaaaacggcagcgtattccactcgggtgctcttcagcgtgtaatgttaaatcgaatttggatatatcatgtttaggagtgacagacgaaatcgacagaccaggcacttcgaaccggaaatcttcactgctgtgaagcacaagcatcgcatcgaacagcgggttgcgatttacctctcgatttgtatcgagcttatctgccagctcctcaaaaggataatcctgatgctcgtaagcggtcagagccaggtggcgaatgtcctgcaaataggagctgaacgttttgtggccctcgggcttgcttcgcatcgccaatgtattgacgaacatcccgatgacgcgctccagatcagcgtgcggtcttccggcagcaggcgaaccgacaacaatatcctcttgcccgcttagcttagataacaaaatagaatagacagccagaagaatcatatacaatgttgttcccgtttcagccattaaacggtgcagctcatcagccgtgtctttatcaatgttgacttcaattgttccaccgctgaaatcagggagacgcggccttgttttatcaagcggtaattctagtgtaggaagactcccgccaagctgaccgagccagtaggcctcctgttttttgtatagctctttcgggtacttctcttgctgccaaacagcaaaatccttataatgcaggtttaaagctggcaactcttttccgcaatataagtcagtaaattcttggacaagagtgctcatcgagacaccgtcggcaataatatggtgcatatcgagcagcaaaaagccgcggtgattgccgattgtaatgacacatgctctaaaaagcggaccggatgatagatcaaacggtttgataaaggtctcgattgcagactcaagcatttgttctgattccatttcaagctcttttagatcaaaagctatctctggataaatgatctgtacaggctcgtctctgtcaagcacaaaaacagtccgtaatgcttcatgccgattcacaagttctgtgagaacgcttctcaaccgctggcgattcagatttccgcgtaattcaagtacagctggcatgttataacctgtgctggcatctgccagctgatgaagagcatataatcgtttttgcgagaaagacagcggatagacatctctttgatccgcaggttcaatctgtgtaaaagcgtgttcttttaagctcatcaatttgaccgccatgctttcaaccgtcggataagaaaacacctcactgagcggcagctcgacattaagctttttatgtattcttgataccagtgcggccgcttttaaggactgtccgcctaactgaaagaaatcatcacgaatgccgatgtgctgtttattcagcacatcttcccaaatatgtgcgagatcagcttcgattaaggttcggggcgccatatatgtgacactcgtattgttttctggttcaggaagcgcaaacctgtcaagcttgccgctggatgttaatggcatccggctgatgttgataatacttgctgggatcatataggacggcaatgtcccggcaagatgctgatacaaatctgggaggctgtttcccttttcgggaacgatataagcaatgagctccttttcctcagcagaaacatcacgggccagtaccgcggcttcctttaccccggtgcttgtcgaagaactgtttcaatctctctcagttcaatacggtaacccctaatttttacttgatcatcaaaacgtccaatatattcaatcgttccatcaggcaaaaagcggcctgcatcacctgttcggtataaacgctccccttcaaggaatggatgatcggagaatgctttctgtgtcagctcttgctgtttgtagtatcctctcgcaagacccacgccggaaatacacagttcacccgccgcgccgatcggctgcatttgatttccgtgcaaaacaaatacttttgtgtttctgatcgggtgtccgatcgtgatcctctctttttcattcagatgccgcaatattgttgttgccacactgttttctgtgggcccgtattcatttgccagttcagcagaaggacaaattatttgactcaactcaagcagatcaggcgtgaccgcttcacccgcaaatgtcacaatacgaagactttttgcatcgtcagcagtcatcacttccaataacacccggtacagggaaggaacaatgatcatgtggctgaccttataacgggctatttttcgcttaagggccagcacatccttcgcttcgtcatctgttgtcagcagtacgcacgcaccagataaaagcggagtaaataagctcgttacacagccgtcaaacacgtacgaaaacaaatggagggatatatcctgttcggtcatgccatactcttcccgtctccattgcaatgtattggcaataccgtgatgatcaactaaaacccctttagggcgccccgtcgttcccgaggtatagatcaagtaggctaggtcacctggcggcatatttggagcttctgtttggtaactttctgtatgttctatcattattgtatttccttcataggacggagggatcaaggaaataaggtcttcttctatcagcaattgagccgcttgactgtccttcagcaggaaagaaagacgttctgctggaaaatgtggatcaagcggcatataagcgccgcctgctttccaaatcccaagcagagctgcaggcatttccattgaccggcccatcattacagcaacgatatctccagatccaacgcctttttctatcagagcgtgcgcaatctgattggctcttacttgtaactggcgataggtccagcattcgtctcccattttcaatgcagcagcttcaggtgttttgtgagcttgttcctcgaacaattggggtatcgttttgttcacataaggacgctcagtttcgttaaacaattggataacctgttgctcctccggcggcacgatattgatgtcactgacggcaacatcgggatttgtcaaaatgcaatccagtgcttgctttagatgcccctgaatcctcagcatctcctcccgctcgtaaacgtctgcgttgtagctgaatttgatataaaatgattctcccggaacgataacgatattaaagtcgtaattggtttgttccgacattgaaatgtcactcagcttcagagcgccttcatcattttcactctccacgcttaacgcctgatgaagctgtacagggtaattttcaaaaacaaaaatatgatcgatcaacccttgcttcaatggactatggttttgaatctcataaagcggataatacccatgctgttcagatgataaaatatcctcctgcacggctttgaccagcgaagaaaacgttatgccttccgcagatcggattcgcactggaacagtattgataaacaagccgaccattgattcaatcccgtcaatcgctgacgggcgtcccgaaatgacggagccaaaaacggcatcatctgcagcattatatcgatggagcagcacgccccaaatactcataaacagcgtgtttaatgtcactccccagttttgggcagcctctgtcagtttctcaaccatatccggcgctaatgaaaagctgacctggtcggctttataattcccgtctgccgtgcggcgctttattcggggaatagaagcagtattgccgtactccttcaaatattcgctccagtaggcagcagtctcttcttgatcttgttctccgagccattcaatataacggctgtacggcaccgtgctgccaagctgtacaggtgagttatttttgagcgaatcatacatgctgaaaaactctttaagaataatgccgagacaccacccatccatgatgatatggtgatgtgtccagacacatgtatattggctgtctcctctatcaaaaagggcaagacgcattaaaggatctttttgcaaatcaaatcctttttcccgatccttagtcataaaagcatcaatcagcgtctgctgttcttgatcagccaggcgagaaatatcttctctatatactgtcaattcacggtttgatagaactacctgctgcggacctgtaagatctggtacttctttaatgaaaatcgttctgaaaatatcatatctagaaacaagaaggtttaagctcttttgaaacgagtcgacgcatagattccctgtgatcgtaaacgaggtctgttcgatatatgctttcgagctgaaatccattagtgaatgaaacagcattccttcctgcatgtgcgataacggataaatatcttgaatttgtgccgattgtgccatcaattccacacaccttttcaaaagttaaagatctttcaccagatcttcgatgctagataatgcagacaacgttaattctttattgctgaaatcgctcaatgttttttcgcgtgcttttttctgcgaacaatgctcaatcgtctcgataagatgcctgtgaaaacgatccataaagcactcaattgagtgtttgctgaacacttgggtgtataccgcttttacgtgaagccgtccgtccgtaatgagagcattgatgtccagctcatactctcgttctctctcacccgctatttcgtaacggggctggtaatatgataattgaaacgtttcaacttccttctcttcgctaaattgaccgagataattaaagctgacctcaggctctttatgccgcagttctcctatgtgtgttaacaatccgtatccagttcctttgttcggtactcttctcagcatatcttttgtcgtcttaattcggtatgcgagctgatcctcgaaaggctcgggaatacccatgtctagcagaataggataaatggaagtaaaccatccaactgtccttgaaatatcaatgtttggcacatgcccttctctgccgtgtccctcagtgctgatcacgatttggtcatgcccagtccattcagaaagcgccattcctaaagccgtaagcaaaagttcgttggcatcagtaccataggcttgctgggtttccaacagcaatttttcagtccagtccccggatagtacaaacgctgctgcgtcgctattcatttggagtctgtctggcacattttctatgtccttaggaagaaaagcagtgtgagcgtctaaaatcgtttgccaatacgttttctctgaaagcaattggttactttcagctatttgggtaagaccatcggcgtaggataaataagaatccgtttttggcggtaattggatttctttcttttctaaagcctgttgatatgctgcagctaaatcctcaagcagaattctccaagaaacgccatctatcacaagatgatgaagtgcaatcagcaaatgatccccttctgccgttttaaacaaacctgcttgcagcaaaggccctttttctacattcattttgctttgaatgacggtttcctcagcggcaagtttttcatcaaggtgagtcctttccagcgatgcttttgtccaatctgaaatataaaggccaaacagttcatgatccttgtgattgattccgcgattaaactgaatgacatggccgttttggtcacgttggaaaatcatgcgaatgccatcatgatgctcggttattttacgcagcgctagatgaagcgcgttagcattgaatcctttttcactgaaaagcatgacggactggttgtaatgatagtgaaaagcatatacctgtccgaaaaatcttcgctgaatcggggtgagttcagcttcaccttccgcaggcccctgatccgcttgagatgccaatggtgtgatatgtccgcatagttcctgaatcgttgaataacggaataagtcgcgtattgtcatgctccagccttcagctgccagacgtgctgccacttgtaatgctttaattgagtctccgccaagctcaaaaaaggaatcgtgaatgccgactcgtggtatgctcagtacatcttcccatatatacgccatcgttttttgtatgtcgttaactggtgcggtatatggacgcgataacacattatttggagccggcaaggcatttctgtccagctttccgtttagggtcagcggcatgttttctaaaggaatcagatgtgcaggaatcatatacgctggcagctcctttgttaaagcagcacggagagcattcgtattgacgtctgaaggcacaatatatgcagccaaaccagcctgtccattcttatcatgctgaacggcaacagcagcttctctgacaagcccagtttgaagcagaacactttcaatttcttctgtttcaattctgtatccatttatctttacttgataatccattcggccaagaagccggatcgttccgtttggaagccagcatgctcgatcaccggttctgtacagcctttctccagagacaaatggattttctgtaaatttcatttgcgttaagtcaggtttatgatgatagcctttcgcaacacctgccccgccgatgcacagctcgccggcaacaccgatcggctgaatttgatcagtctggctgagtacgtacatgtgtacattcggcagcgggctgccgattggcacgttatctcccgtacactctccacccacactggtttcatagaagctcgaatcaatggttgcctctgtgacaccatagctattaatgatgcgcatgctttggccaaagcgatctgtcaatgttttgaaatcttgagctttcaccatgtcggaaccaagaatcagtatgtctaagtcaggaagcttgaactggttacggtatacatactccatcaccgggataatgagagccggtgtcgactccatcaccgtgattctctgagagttcatgattttatatatttcagcaggttccagccgtgtttcatctgggcaaacgattagagtcccgccgttggtcaatgttctcgccaaatctcctgagaagacatcgaatgaaaagctcgcgatttgaagcagtctgacaggcttccgatccagctcatatatttgacgccaagcaagagcagcatgagtaaagttccgataggtgacaatgacgcctttaggcgcacccgtcgttcctgacgtataaatgatatataccggctcttcaggagcaggagataagttaaggttgcagttactttcttcataagtgctttcatcgtcaaggcagatatgagacatctcagattcaggcaagtttgaaatcaaatgcttcaactcctgctgtaaaagaagaatatctgccccgctatcacgaagaatgtattcaatacgagcttttggataatgtgaatcgattgggatatacactccgccagctttcatcactgccagcacgccaacaattgcatcgatggaccgcttggctaaaacagccacagttggcttcggtccttttctgttttgcaatgttcgtgccagacgattggctctttcatttagaagccgatagctaatctctgtttcgttatcaataacagctatatgttctggaatttcttcagctttcgcttcaaatatgtgatgaaaaggaacatctttttgagcaaattcaacctgagttttgttaaatccaaagactattttttgtttttctttatcactaagtatgtttatttgtgcaaggcttgtttcaggagttgaaagtgccgcatgcagaaattcggtaaaatgatcggcccagcgttcaattgtagctttcaggaatacttctgtactgaattccatttcacagcaaatagatccatttatttccgtagctattaatgtgatatcaaataaggaaatgtgatgtgcgaaattggcaggccggacttttatttctctcagatctatgtcttgtttttccacattttgaaggataaacatcgcatcaaacactggattccggctcatatcccgtgtcaattcaagcttatcgacaagttcttcgaacggataatcctggtgctcaaaggcttccaatgctgtctcacgcacttcctgcaaatactgtgcgaatggcttcccgccctccgggcgtgtccgaagcgccagcgtgttcacaaacatgccgagtatcggctcaagatccttgtgcggccggccggcaattggcgagccgacgatgatatcttcctgtccgcttaagcgtgacaagaacgcggtgtaagccgcaagaagcaccatgtacagtgtgcttccgttttctcgtgccagcttgtgaaggcctgatgtaacctctggttccagcgtaaatgagaccttgtcacccgcgaagcttcgcaccggcgggcggacatgatcagccggaagatccagcacaggcagctcgccctcgagctgcttcagccagtacgcctcctgcgttttgtacgcgtctcctgttttgaatccttcttgccatacggcatagtctttatattgaatgcgcagtgccggaagcttccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctcttcggttcgtgcgccgagaactgtagtctgtaacgtaaacggcgcctcgtcatggatgcgctgcaccggatcgcctcctgcgtcctgttcgaaggaggtccgaagcgactcgtggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgccgtgtaggtctccgcatctgccgctccgtcaggagctggcagggcgtttcggtcgagctttccgcttggcgtaaccggccactgttccatctctatcatataggctgggaccatgtagcccggcaacagtctctcaagctgtgcccgcacttcgtttctttggagcccttctacataagcgcataattccggctcgccgctgtctgtccgtacggtaacggccgcctcccttacgccttttatgcttcttagtgccgtttcaatttctcccggctcaatccggtagccgcggattttcacctgatcatccaaccgcccgaggaattcaatattcccgtcagggagccagcgcgcaacgtctcctgttttgtacatgcgttcccccgggtaaaacgggtcttcaagaaaacgctcctccgttaatgccggccgattcaaataacctctggcaacacccgctccggcaatgtacagttcgccggcgacaccggaaggctgtacggctaaatgcggatctaaaacatacaaacgcgcaccgggtacgggcttcccaatcggaatccgcaagcggtccctgtcccgttctggatccaatacgtaaaatgccgcgtctaccgttgcttctgtcggcccgtagccatggattaatgagacctgcggcaatacagaagcaaaatgggctgccgtacgcggcgcaagcggttcacctccggcgaaaacacgcttcaggcttgtctcgtcaccgagcgctaacatttccgcttgatcgagaaagctgttcagcatagccggaataaaatgagccgttgtcacgttttcctgatgaatggcttgtacgatcaacgcggggtcgttttcccagccgggcggaagcagatacgccgaagcaccggaaagagtccaccaaaacagctgccagacagacgcatcaaaggaaaaagaggttttcaccatgacaatgtcatcttccgaaagcggaaactggtgctgcatgccggtcagaaaagaaacagcctggcggtgctcaacggccactcctttcggctgcccggtggatcccgacgtataaatgacataggcgagagacccgtcgctaacagaagcagacacataacgttttacttcttcacgctcaagagatgtcatgtccacttcaagcatttcgccagaaaagttcggtgcggagcatcccggctgtgtcagcaagagcgatgccccgctgtctttcagcatgtagctcagccgctcctttggatacgcaggatcaagcggcaaatacgccccgccggccttcaagacagcaaggacagcgatcagcatgtcaggtgagcgttcagacaggacaccgacgatactttcgtttgtgacgccgcgtgccgtaaggtgcgcagccagccggctggcgtacatatcaagctcagcgtatgtcagcgaaccgcctgaaaagcgaatggccagccgctccggtgtgaaagctgcctgtcgctcaaacagcccatgcagggtgaaagctttaggcgaaacagcttccgtcttgttaaactcatacaacaatttttgcttttctcttgtattcgtcatatctaattctcttataaagctgtgcggatgttgaagggcgttttccagtatggtaagcagatgagattgtattcgtttaatatcctcaagagaaaacaaggtattttgatagtcgaaatttaattgaatggttccattgtctatccgttcttgtatttgaactgaaagctcgttcgcggtgtatccgctgaaataaagcgctgtttcatagtcaaaatcatctgcattatgccactgaagtggctgatactgcatagatataccgataaggttgtgtaaatccttctgttcatttcttaattcatttacaagcaaattataaggaaaccgttgatgacgcataacagaaagctgttccctgcctattgtgcggacaaaggaaagaaaatctgtgtcaggatcaaccgttattctgattggaagagaactaacgaacatgccgagcatttctttttcagcctttgaccctctgttgccatagtaggtgccaatggcaagatcttttttagaagtgattcggctgatgcatatgtaaaatgaagccataaataaggaaatgatattgatcttgtgtgcttcgcaaaagattcgaatcgtttgctctagatcaggtgaaagaatgatggtgtctctggatgcagatgtgctctgtttttgtaaggacgtctggtcggctaacgagtggtattccaacgggtgctcaaaggtttgcgtccaaaataaacggtcctttacaaaccgcggagattgtagatattgactctctttttcgatgtagctcaagtaagaaggttccggctgatcaggtaaaggatctttctttttcattttttgataaagatctataatttgatttcccatcacatttaaagagattccatccattatgatatgatggaatttcgcaaatagccaaacttcatgagagtcaattctaaggaggtaaaattgataaagaggcgagttgaacagtttaaatggaatgctcgcttgatcctgaatccattgctctatttctatcatttcaacatttgaaaaatcaattattctaagtggataatatttatattcagtaaggtgcaatcgcggctcaagctcttctccttctaacagctgaaatctaatggcgtcgttgcgggagatggaatgattcagcgctccctccagagtatcaagcttaatattgcctttgaatttcacacaggctgtgagattgcaaatgctggtatctggctccagcagttcggtaaaccacactctcctttgggcatgggttaaagaataagtatgttcgctcaacggattccctccagttctcataataagaggataagaaaaagtagaaaaaagcagaaaaatgtcaataaaagaaattatatgactatataatccatatatgcactatattaacggatattttttaaagtacaataaaaaacattaaatttttataacatttttttgaatatagtattatttctttatttttcgtttctttttttatcaaatttccggatataaagtgataaaagtattgttttacataaggtcttatacactactttttaatcgaactaattttcttttgtgcatcattcttctaattgttggaaggttcgacaaagcgttattacagacataaaaaaacctgttttctcttggaaaacaggtctgccgctattattgatttgccaaaatgacagcgatttgatcctcaatatcttttccatcctcttcatcaatcaatccatttagaagaatagagaaaacaagtttttttccgctctttgtttctgcgtaccccgatagagagcttaccgtactgagcgatccggtttttgctcttacttttccttgtgcaggagtgtctttcatgcggtttctcagcgttccgcccaccattctgtcaggattgcccgcaacaggtaaagaatttagataagccgcgaaccaactctgatcctgaatgtcatataacagctgtgaaagttgatctgaggatacagcatcaatatgtgagattcctgatccgtcccttaagacgagtgatttagaatcaacaccaaattccggaagcgtactgtttaacacttcgagccccttttcccagctcccttctcctttttttactttccccatctcttttacgagcacttcggcatgtccgttattacttaatttcatgaacggcacaaaaagtttcgataaaggcattgagcgatgagagagcagcacatctgaagaactaggtgcttcacccgtcttgatgttccctttcacagtaattccttgtttttttagtgactgcttaaataaatctaaggcatatccggcaggctcccagacagaaatccattcctttgtcttgtttgcgtcaaccggtacgctcccttcaattgtaatcgtgtttgttccatgctctctttcgattgtgaggtctttatctgaaccggcagcagtcgtttcagcatcgttctttatcgttatataatcggttttcggagagacagacacggcaggctcttccccttctttttgatttggggtgacttcaacaatcacagtgcctgcatcatagtcttcgtttggagacgctgttagagcggagattggcgcgccataatatgtgtattcatcgctccaaggcatatcaggtgataatcgcatgtcatcatgccacgtatcatcaccgatcagattgcctttaattacttttacgccggaatgtttcaatttctcagccattttgtcaaaatcagatggtaaaagtgtcggatcgcctttccctttcaaataaaggttaccattcagctttttccctttcagtgttccatccgtccggacctcggttgtaaaagaatagttctcgccaaggacagaaagtgccgcggccgctgttaaaagctttagagaagaggcaggcctcattcgggtgtctcctgaatgttcatatagaacagcacctgtttccgcagagcgaacggtgatgccggccattgcgccttcgagggcaggatgatcagctaaaatcttatcgatctgcccggaaagtgcatcttgtttttcagcggcaagcgcagcctgatgcatataaggcaccgaagcaacgacgaaaagcagtaaaacagcaacataaagctttatgctttttttcattaatttccccgcctctctgcgcttcatcattggctattgatgattcagttcaatggtgatactgcttttagctgttgtttcttctcccggctccagcacttgtaaaccagtgagtgacgaaggtaaatcaagattcactgcgtttgtcacccatgtgtaaggttcagggcataaatacccttgttttccgtccgcattgtatacaacccaatgtttaaactgttcatctgccttataaataatgctgatatgtgcatgctgatgataaatgactgcctggttttctccgcccctcttctgataagaagataaaaagacatcatccagctgcttgtggcgcaaatccattccttcatgcaaagcttctttattcggtacatccatcagtttcccggtcggcagcaggcgttcatccaactcccattgctgatctgctgtcagggagaataacgagctttctgccggaaacacaaatgtagtatgataaccaattccccaaggaaacgcttcctttcctttgttcatgaccgtcgcatgtttaaatagagtattcccctttaccgtgtatgtcatccgaacgacggcatggtgaggaaattgcttatacacatgggggagctcagaaagatcaatttctgtttcaacaatcacttcttcatcagttttcttcgcggtcactacgttccacttttcatggtaaagaaacccatgaagatggttgtgtttatccttctcgttgatatcaaaatgatacgttctgccccggaaactgaatgtaccgtcacttatgcggttaggcgggaacaggattggaatgccatacaatgttggtgtgtcgtgaaaactttctgctgtttccggttcacgcaaaagctgaacttttgttgtgttgtccacgagagaaataacgttgctcccccactcagggacaacaatcatttctagatgttcgttgcccgctttgatggccggcgttcccaaatacgtgattttctcaataaagtttgccatgtttactcaacctctccttgattcattgctagtataagaattcaatgtactgtaccatatttcctccattttatattttcccctatcaaataaaaaaacaccgttcaaacttatgaacggtgtgattcgaaggctattggatgagacgtgtgatttgtttctttttccagacgaattgataatacccataaatcaacagcaagctgacggcaaacgcagctggataaccaacccagacgccgagtatttcaagctttgtatagtgagaaaggacgaaagcgacaggcacctctactccccagattgcaaaaatactgatgacggtcggccataaaaccgttccgcttgcccgcatcgttgcagaaataatttgggcatttccaaacagcaaatagctccacaatgtaatcatcaaaagacggtgcgcaatgtaaagcgtctcttgctcggttaaaaataacgataaaatctgatgtgaaaaaacatagatcagaatgatcagtacgccgccaatgatataattcagccaaatccccacgcgaatgacctgctttaagcggtcaaactcgttcgctccgatcgattgcgcagcgaaaatagaaaccgcaataccaaggctgacggccggcatctgtacatagctggccacctggttgaccactccgtatgcagctgttgcattagagccgtaatgattgacgaatgaaataaccgctatctctgataatgagacaagaatcatattgatgcttgctggaaccccaagacgcagcaggagaaccagcagttccttatccattttcaaataacgacgcactgttttatcaaattgcagcgggtgttttcgctttcgtaaatacaccattaacacgagaaaagtcgcaatcgtggaaatgacagttgcatatgccgagccgtatatgcccagtttcggaaaaccaaacatgccaaggattaagacaggcaaaagcgcaatgttgataaccgtgctcacaatcagcgtataaaacggtgtcttggaatctcctgttccgcgcaaaaaggtagtataagcaaaatataaaaacataaatggcatagcataaaataaaatacgtgcatagttagcgctgacatgaatgacattttcaggtgttcccattaaacgaagaatatcgagggtgaaaatactgccgatgacggctaacacaacgcctaataaaaatgtaaacgtgagcgtcgtcccgacaacagcctttagccgttcctcatttttcgctccgtaagcttgtccgatcagaatcgaacttcctgaaccgatcccaatcgtaaatgagattaaaagaaaaaataacgggaaaaaggatgatacagctgccactgcatcaacaccgagccatctgcctacagccatcatcccgactagctggccgactgattgcagcacattgctcagcagaagcggcactaaaaagagtgacatcgaccgccaaactgatggtttgcttttcttttgagttacaagaggttcttgtgatgtttccatattaaaggactcctttatttgaaatcgtttttaaacatgccctcattttttgacaaaaacaggatatgtaacatgttattattcatcactgcacatatgaaacccttcccgattcttctaattttacacatctttttagcttatgaagaataaactagcaagtaatggcgtattttttgtgagtaaaagaataaaaaataatttatgcaaaagtattgtaatctatccgtaactattgtaacatttgtaacataagagaaagagattttgaaggagagagcgataatgaaaaaatgtcttctatttctaacaaccattgcacttattctgtcattaagcacaaatgcatttgcgaaaaatacatcaggcgatttatcacaaaaacaagcattacagttggcattatccgctagagaacatttttggaacaccatgagcggccacaatccgaaggtgaaaaaagcagtttgcccatcaggcacattcgagtatcaaaatcttcaatatgtatacatgtgcagtgatctaggcactaaagcaaaagcggtgaattacttaactcctatttttacaaaaacagcaatcgaaaaaggctttaaagattatcatttcactgtttctaaaggaaaacttgctgttccaatcggtgacggagacaatcttttgaattggaaaaaatcaactgctaaactggtctctaaaaaaggcggcacaatcacatacgaatttaccgtccctacattagacggatccccttctgcaaaacggaaagtgacattcgtgaaagaaaataaaaaatggaaagtcaatcaatttgacgcagttatataagaaaaacgcccggtataagcgggcgttttttatttggtttgcataaagaaagacaacaggcgaaaagtgcctgttgtctttttgtgaatataacgctctaggagagattcgaactcccgacctgcagtttaggaaactgctgcactatccgctgtgctactagagcttttggtatttatatagtagctctgatgatcaatattttcaaacgatttgtattaaagccctccaaaaaccttatatgcggctcttgtcgtatcttcatcaataccgatataccgcattgtaattgatggtgatgaatgattcagtattctctgcagctcggcgatgtctttcgttcgctgataaaaatgatagccaaacgttttccggagtgtatgcgtccctatctcctcaaggccgcacgccgcagcggcctctcttaaaattctgtaggcctgaatgcgggaaatcggcttcctggtccgcactgatttaaaaagatattcgttttccttcatgtctttcgtatactcgtatatttcctgtttcagcgattctaaaataagaatctttcttttctttttcgttttgctttcagtcgcccataaatgatctttattttgaacgtccttcacttgcagcggcagaatatcagaaatgcggagcgcgctgttgatgccgaaaataaacagaaaataatcccgattgtttttgttaagcaaatactgtttgacttcttggattttctctagactgcgaattggctgtacaatatgcatcaaaaaactccttaaaaaccgttatgtaacgttttgaggtctatgttactattatagctgaaaaacgttgaatgtcaaagtgcggcggcatttatgtaacataatatacatagtgttacataagcttttaaaaaagcttcttcaaaccttcaccctataaaataagctttaaagcctcttataaagcttttaacctcttggatacttatccccctgccaatcataaaaaaacctcttaaaacgaaatctgaagctcccaattttcaggagcttccgcaaaaaaacatacaaaaaaagacacaatttcaaattgtgtcctaatcctcatcctttacatcaatatcttccgggattggttcatttaatatttcctgcacaagtgctttgtaattctccagctgttcaagatgcgttttgaactgctccttataaatcaaaaattgctccccgtcatgaacggctctgattttcccttcgagcaccaagcttttaatataatcctctgaaagatttgtatattctgctgtttcttcaatcgttaaatacatatagcagtcccttcttaatccgtatgctgattctaatatagcacatggctcatatcaatataatcaattttgcacagaaaaacggctttatgcactatataatataccatttgtcacttgtgaaaacgctgtaatttttttacgctaagattgtaacaatacagcttcatataggagggagaacatgaaaagaacgtggaacgtctgtttaacagctctgcttagtgttctgttagtcgctggaagtgtcccttttcacgcggaagctaaaaaaccgcccaaaagctacgatgagtacaaacaagtagatgttggaaaagacggcatggttgcgaccgcacatcctcttgcttctgaaatcggtgctgatgtgctgaaaaaaggaggaaatgctattgacgcagcggttgccattcaatttgcactcaatgtaacagagccgatgatgtcaggtattggcggcggcggttttatgatggtgtatgacggaaaaacgaaggatacaacgataatcgacagccgtgagcgtgctccagcaggcgcaactcctgatatgtttctggacgaaaacggaaaagcaatacctttctctgaacgtgtaacaaaaggtactgccgttggtgttccaggcactctgaaagggctggaagaagccttggataaatggggaacccgttcgatgaagcaattaattaccccttctattaaactcgctgaaaaaggctttccgattgattctgtgttggcagatgccatttctgattatcaggaaaaactttcacggactgccgcaaaagatgtatttttaccaaatggcgaaccgcttaaagaaggagatacccttattcaaaaggatttggctaaaacatttaagcttattcgctccaaaggcactaacgctttttataaaggaaaattcgccaagacgctttctgacactgtccaggatttcggcggatcaatgacagaaaaagatttagaaaattacgacattacaattgatgaaccgatttggggagactatcaaggctatcaaatcgctactactcctcctccaagctccggcggtattttcttattgcaaatgctgaaaatccttgatgattttaacctttcacaatacgatgtccgctcatgggaaaaatatcagctgcttgctgaaacgatgcatttgtcttatgccgaccgtgcgtcttacgcaggtgatcccgaatttgtaaatgttcctctcaaaggcttgcttcaccccgattatattaaagaacgccagcaattaatcaacctagatcaagtgaataaaaaaccgaaagccggtgacccttggaaataccaagaaggatcagcaaactataaacaagttgaacagccgaaagacaaagtagaaggccaaacaacccactttacagttgctgaccgttggggaaatgttgtttcctatacaacaacaatcgaacagctgttcggaacgggtattatggtccctgattacggtgtcatcctaaacaatgaattaacggattttgatgcgataccaggcggagctaacgaagtacagccaaacaaacggcctttaagcagcatgaccccgacgattttatttaaggatgacaagcctgtcctcactgttggatctcctggcggggcgacaattatttcatccgttttgcaaaccattctctaccacattgaatatggtatggaattaaaagcagctgttgaagagccgagaatttacacaaacagcatgagctcttaccgttacgaagacggagttcctaaagatgtcctcagtaagctaaacgggatgggccacaaattcggcacaagtccggtggatatcggaaacgtgcaaagcatatcgatcgaccatgaaaacggcacctttaaaggtgtagctgattcaagcagaaacggcgcggcgatcggcattaatttaaaacgtaaataaataaaaaaactgtactcgcttcaaatgagtacagtttttttatacacatctttaaaataaaaactgacaaacgtctttattctgctaatgcagtgtatcagaccagaaatccaacacgtctatcttcatcttttcatttcgtttatctcatcaagaaatgtctgaaacgcactcgtaataaaaaagtctttcctgtgtataaagacgatctccaagtcttgatatgctggcggcagtttatgaatccatacatttgtacgatgctcggagccgtcaacagcggactttgggagcagcgccgtacccatcccggcggaaacaccttttataatggcctccaatgtgccaaactctatgatttttggattgtgtaggcctgcttcctctagtaatcttttgaccctgtcacgatgagaacagccagccccaaaaaagagcatcggctgctgaagcatgtcttctgccgtctcttctcgtgatgaaatcaaaactaattcatcatgggaaacatggagttgtctaactgcagcgtgttcaaccggcccatatacaaaagcgccatcaactttatgatcaagaacctgttgaatcaaatgatgcgtatccgctgtgttcactgataaatccacttcaggaaaacgcctgaggaaggatgctgcatgctcaggcagatgcgttaccgccgtcgtttccagtgatccgatccgcaaaggcccttttggttgcctgctcattcgggtcgatttttcagctttgtctaacagcgataatacttgatctgcatattgtagaagattttctcctgcagcagtcagcttcatcccccgattcgttcaatgaaacagcctgatattcaaatcttcctcaagcttatgtactcttgctgtcacattcgactgaacataattcagcatttgggctgctttcgttatgcttccttcgcgggcaacagcctgaaaaatctttaaatctccgctttccacgcgctctcacctgcttgctatgatgaaaagtgatattggctatcatatttgttcattttactcgaagaaaaccgctatgtaaaatatgtaaagatatgaaaatacaattcaatgaggaggcagacagcatgaaagctgtaattcacaacggaaaagccggccttcaggggttatcagtcgaggacgtttcatcaacaaagcctggatacggagaggtaaaggttaaattaaaatccgcgggcctgaatcatcgtgacttgtttcttatgaaaaacaaatcggaacaagatcctcacatgatactgggttctgacggcgcgggtatcatcgaagagattggtgaaggcgtgaaaaatgttactgttcagacagaagtagtcattttcccgacattgaactgggatttaacagagaatgtaccacctgtacctgagattctgggaggtccttcggacggaacacttgctgaatatgtgatcattccttcacaaaatgcaatcaaaaaacctgcttatttatcttgggaagaagcgggcgttttacctttatccgctttaactgcatatcgggctctgtttacaaaggggcaattaaaaaaaggcgagcatctattgatacccggcatcggcagcggtgtggcaacctatgctttatttatggctaaggcgattggggcaacagtaagcgtgacctcccgcagtgaggagaaaagaaaaaaggcgctgcaattaggtgctgattacgcatttgacagctacagcaattgggatgagcagttgcagggaaaaaaggcggatgttgttcttgacagcatagaacctgctctcttttcggaatacttccgccatctaaaaccaaatggccgtattgtcagctttggggcaagctcaggggataatctcagttttccggtgcgttctctattctttcctcaggtcaatgttttggaacctcgatgggaagcggtgaggaatttcaagctatgctcgctttcattgacaaacataagctgcgccctgtaattgaccggatatatcctttagaaaaagcatgtgaagcatataaaagaatgcaggaaggcagacagtttggaaacatcgggatcataatggaataaaaaaagaaaccggctggcaacaagaccggtttctcttatatgataatcccctttatttacggaagaactgaactccccatcaaatatcgatccacttcacgcgccacttcacggccttcattaatcgcccatacgattaagctttggcctcttcttgcatcccctgcggcgaatacaccatcgatatttgtttgataatccccatatgctgcactgattttgttatttactgaatcaacaccgaactgtttcaacagcggctgttctgtgccttcaaagccgatagcgataaagacaagctgagcaggccatactttttccgttccaggcagctcgcggaactcgtattttccatgctcatttttcactttttccatttggatagtatgaagctctttcagctttccgtttttatccgcaaccatttttgtcgtttgaatggagtattctctcggatctcttccgaattttgcttctgcttcctcgtatgcatattcaagcgtaaagacgtgtggctgttcaggccacatattgtcattcgtgcgggctggcggaagtttcgggtgtttgccgaattggtgcacgcttttggctttttgacgcagagcagtagccacacagtcagctcctgtatctccgcctccgattacgatgacatccttccctttggcatcaatgaattgcttgtctttaaaattagaatctaaatagctttttgttgcaagtgtcaggtagtccatcgcgtaatggactccttttgagtcgcgtccttcaattaagaggtcccgctgtttttgagcgcctgtgcataggatcacagcatcaaattgctcctttagctcatcagctgtaatgtcaacaccgatttctgtgttcgtgacaaaatcaattccttcttgcgtcagcaatttaattcggcgttctacaatgcccttctcaagcttcatgtttggaatgccgtatgttaaaaggccgcccgctctgtctgagcgctcaaaaacagtgacggaatgtcccgcttgattcagctggtcagcactcgccagtccggctgggcccgacccgacgatagccacttttttgcctgttcgtttttttggaattctaggttgaatccaaccgttctcaaatcctttatcgataatggtccgctcgatgtttttaattgatacggccggatctgaaatcgctaaagtgcatgatccttcacaaggagcgggacatacccgccctgtgaattcaggaaagttgtttgttttcaacagacgttccaatgcttccttccatctgccccggtagacaagatcattccattcaggaattaagttgtaaatcggacagccggatgtaaatccgttaatgtccgcaccgatctggcaaaacggtgtaccgcaatccatgcaccgcgccccttgccgtttcgatgcttcttctgaaaaaggagcagaatattctttccaatcctttaagcgagtgagagggtcccgctccgcaggtttttctcttttgatctccataaatccagttggtttccccatgttcctctccccttccttactgtactaccgcttgtttttgtcccgaagctgctgtattctgctttggcttcgtgttggcctcaaaagcgaacatgatagcttcttcatctgataaacctgcagctttttgctcttcgatgcttgcgagcatttgtttatagtttttcggaatgactttgacgaattttttcacactgtcttcccattgatcaagcagatcttctgctttttggctgtttgtatacgcagtatgtctttcaagcattgctttgatttgctggatttctttctcatcctctaatgattcaaataaaatcatctcaaggttgcatttgcgtttaaacgccttgacatcttcggccagtacataagcgatgccgccggacatacctgccgcaaagtttttgcctacatcaccgagaacgacaacgctgccgccagtcatgtattcacagccgtggtcgccaataccttctacaactacgttcacaccgctgtttcgaacggcaaagcgttcaccagcacgtccgttaatatatgcttctccgcttgttgcaccgtaaaaagccacgttgccgataatgacattgtcatccgaagcagagttgaatccttctggtgacttgacgatgatttttccgccagaaagcccttttccgacgtaatcatttgagtctccgtccaaataaagcgtcatccctttaggaacgaaagctccaaagctttggccggctgatccggtaaagtgcagcttgattgtatcttcaggaagaccttcttctccgtaacgctttgagatttcactgccggttatcgttccggctacacgatttgtattattgatttcaatcgaaatatcagcttcttttccagattcgatggcttcttgtacagccgggagaattgttgtgatatcaagcgattgatcaattttatgattttgcggagattggaatgtccgcactccttcaggctgataaagaagtgtagacaaatcaagctggcctgctttccagtgccccttcgcccgttcacttacatgaagtacatcagtgcggccgatcatttcatcaaatgacttgaagcctaacgcagccatgtactcacgaacttcttcagcaatgaacatcatataattcacaatatgatcaggatctcccatgaactttttgcgaagctctggattttgtgtcgctacaccgacagggcatgtatccaaatggcaggcacgcatcatgacacagccgagtacaactaacggagctgttgcaaaaccaaattcttcggcgccgagcaaggcagccatcacaacgtcgcggcccgtcataagctttccatctgtttctaatacaacacggtcacgaagtccgttcagcattaatgtttgatgtgcttctgcaaggccaagctcccatggaagccctgtatgtttaatactggttttcggagaagcgcctgtacccccgtcgtacccgctgatcacaatgacatctgcagtcgctttggcaacacctgcagcaattgttcctacacctgcttttgacaccagctttacgctgattcttgcgtcacggttggcatttttcaaatcgtggatcagctgggctaaatcctcaatcgaataaatgtcatggtgtggcggaggtgagattaatccgacacctggcgttgacccgcggacatcggcaacccatggatataccttgttgccaggaagctgcccgccttcacccggcttagcaccttgagccattttaatctgcagctcgtcagcattgacgaggtaatggcttttgacaccaaaccgtccggatgcaatttgtttgatcgcacttcttctatcatcgccgttctcatctggaacaaagcgtttgggatcttctccgccttcaccgctgttgctttttcctccaagacggttcattgcgattgctaaagcttcgtgcgcttccttactcaaggacccgaatgacatcgcacccgttttaaaacgtttgacaatcgattcagcggattcaacctcctccaacttcaaaggcttgcggtttccgtcaaatgcgaacaagttccgcaaaaatccgatgcgttcttcatcagccgcttttgtatactgtttaaacagattgtaatcatttctgcggcacgcccattgcaaagtatgaatcgttttcggattaaacgcatgatgctctccgccatttctccattggaagtcacttcccggttcaagcgttttgctgtaatcatcctgatacgcttcccggtggcggcgctgtgcctcttctgcaattgtttgtaaatcgatgccgcctagctgtgatgcagtacctgtgaaatagcggtcgattacatcgcggctgattcctaccgcctcaaagatttgggcgcctctgtagctttgcacagttgaaattcccatcttggacatcacttttacgacgccctcagtaatgctttttccatatttgctgaccgcttcttcatagctgatatccaaacggccttcatcaatttcctgcttgtaggtcgcataagcgagataagggttaatcgcatctgcgccataaccgattaacgctgcaaagtgatgcacttcacgtgcttctcccgattccacaatgatgctgaccttcgtacgcagccctttgcggattaagtgctggtgcagtgcgcttactgccagaagcggcggaattggtgtcagtcgttcgttcatctttttgtctgataaaattaacaaacttacgccttggctgatggctttctctgcctgtgtgaacatgtcctttaatccgcgttcaagatcctctgaaaacagcacatcaattttttggctttttaaatcaggatgaacaatcgttttcaatgcgtaaaactgttcattggataaaacaggtgtatacagtttaatccggcgaacatttcgttcacttggatgaagaagatcgccttccgcaccgagccaagtcatcgttgaagtgacaagctgctcacgaatcgcgtcgattggcgggttcgttacttgtgcaaacagctgtttaaagtagttaaacagtgattgcgctcggtcagaaagtacagcaagcggagcgtcattccccattgaaccaaggggatctttgccttctttaataacaggaattagatacttttggatatcctcatatgtgtatccgaatgccttctggcgagtaagaagatcactaaattgttcttcttctcttgactccggatcaggatttacttgtacaagctcttcttcaagccatttttgatacggatactcagttgcaatttgtgttttgacttcctcatcggagataatacggccttcttccaggtcgattaaaagcattttcccaggctcaaggcggtttttatataaaacgttctcctgttcaacttcaataacgcctacttcagatgagaaaataatataatcatcttttgtgacataataacgggccggacggagaccgttccggtcaaggatcgccccgatttgtttaccgtcagtaaatgaaatggctgtcggtccgtcccaaggctccatcagggagctatggtactcgtagaacgcccttttttccttggacatatgcgtattttccgtccaaggctctggaatgagcatcattgccgtatgtgccggtttgcgtccagccatcacaaaaaactcaaatgcattatccaaaatggaagagtcactgccatcagcattgagaatcggcaaaatcttgtttaagtcctcaccgaagctttcagaaacaaattgctgctcacgtgctctcatccagttaatatttccgcgaagggtgttaatttcaccgttgtgaaccaaatagcggttaggatgcgctctttcccatgtagggaatgtattggtactgaagcgtgaatgaacaagcgcaaaagcagaaacgaatgcttcgtcttgcagatcagaataaaatgcatcaacctgttcaggtgttaaaaggcctttgtaaacaatggtctggcttgaaagactggcaaaataaaaatcaagaccttccgttactccccaattttcagcctgtttacgaatgacatacaattttcgttcaaaagataaattgtcctttagatcagaatttgcgccgataaatacctgacggacaaacggacagcttttttgcgccactgttccgatttttccgacatttacaggtacagttctccatccaagaacgacttggccttcttgttcaatcagtgcattgatttgcttttcaattttttttctttcatcttctttctgagagaaaaagaccattcctaccccgtaacgttctttttctggcagattgatgtctttgcactcttttctaaagaaagcatcagggatttgaaccagtaagccggctccgtctcctgtatccggatcactgccttgccctcctctatggtctagctggcaaagcatcttaagtccttgtttgacaatgtcgtgagtctgcttgccctttaagtgtgcatataggccgattccgcatgcatcatgttcaaattcaggacggtagagaccttgagcttttggcatttgattgtacgtcataattcctctcccccgatcaatttccgataataccggtcataaaatctaacaactctataatcattgtaggttttcaaaacgatataaacaatatataatttagatcaaaagaatctcaaaatgagatagatggatgtgagacaaacatggagctgcgccaactgcgttattttatggaggtggctgaaagagaacacgtttcagaagccgctgatcatttgcatgtggcccaatcagcaatcagcagacaaattgccaatcttgaagaagaattaaatgtgaccttatttgagcgtgaagggagaaatatcaaactcacgccaatcggaaaagaatttttgattcatgtgaaaacggcgatgaaagccattgattatgcgaaagagcaaattgatgagtatcttgacccgcatcgcggaacggtaaagatcggctttcctacaagcctcgccagccagcttttgccgactgtcatttcagcgtttaaagaagaatatccgcacgtcgaatttttgctgcgccaaggctcctataagtttctgattgaagctgtcagaaaccgcgatattgatctggccttattaggaccggtgccgacgaatttctctgacataacgggaaaaatattatttactgaaaaaatttacgcgcttgttccattaaatcatccgcttgctaaacaaaaaacggttcatttaatcgatttgcgcaacgaccaatttgtattgttcccggaaggatttgtacttagagagatggcaatcgatacttgcaaacaagcaggctttgctcctctcgtttccacggagggtgaggatttggatgcgatcaaagggttagtgtccgcaggaatgggcgttacccttctgcctgaaagtacttttgctgaaacaacacctcgttttactgtgaaaattccaattgagttccctcaagtaaaacggactgtcggaatcattaaaccgaaaaatagagagcttgcgccttccgcgaatgatttttatgagtttgtcattcaatttttctctaagctggagcagtatcaataaaaaaatgaacccgagcttctatatagaagcttcgggtttttttctgcaaattaatttacaggtaaagaaaaatccacatggcaaacaaatgcttcttgatcaattagagctctatttgtcagttcctttttcttttccggttcttgaagctgtacagaagagtaattgacgattccaaggccgatttccgtcccttttgaatccatcagccgaacaactgaaccgcttttgaatttccctttaatcttctgtacaccgtctaagtataaactcgattggccgtttgttatttttcgtgaacaatcatctgataaaatcatttcaccttccggaccggaattaaaagcgatccattgctccttttgattcaacggaagcgttccttctgcttcaaaataggtgccttccgcctgttcatgaacggcgtggtataaaatatcgccggcatctgcctgacctaggaaacctttaatgccagacgccattacgattttaaacgcatcaagcttagaacgcatgccgccggtgccaacgatgcttccagtgtcacctgcgcatgcttcgatgtcaggtgttatttcacttacccgctgtatccttttcgcttctggatttgtgcgcggattgccgtcatataatccgtctatatctgataaaatcacaagcatatctgcatcaatcaaacctgcgacttttgccgcgagcgtatcattgtcgccaaacttgagccgattgacagtaactgtgtcattctcgtttatgatcgggataatgccgcgctcgagcagtacattcattgtattcctgacattgttgtatcgatattcatcagaaaaatcgcttctcgtaattaaaatttgggatgcgacatagccgtgtgccaagaacagctttgaataagcctccatcagcaatccctggccgattgaagctgatgcttgtttttctggaagcttctcgggcctttggataaatccgagcttccgatatcctgccgccactgcgcctgaggaaaccaaaatcacttcataaccggcgtctttgagtttgacgacctggtcgaccaacgcttctaattttcgaatgctgatttctccgtgaaggcttgttaatgaactgcttccaatcttcacaacgactcttttcatgcttgtatcaggcgtcactttatcactcctgatagcggcgctgcagttttttcgatatcttcgctgatttcctttgaacgcttagccgcatgctttatcgcttgagaaatcgcttctccgccgccgctttttttcaaggcttgcagccccgctgctgtcgttccgttcggtgacgtgatattatctcttaagatctcaggatgttctcctgtttccatgagcatttttgcggcacctaaaagtgtctgtgcgccgatgcttcgagataactgtttatcgaggcccgcttcctcgcctgtcttttcaatgaattccattaaataataaaaatacgcggggccgctgcctgcaattccggtgaatatatccatttgattttcttggattgtatagacttcgcccatgcatccgagcaatgcttcggccagcttcttcaagtcttccgacacatatttgccaagggcaatagctgttgcagaagcgccaatcatactggaagtgttgggcatcactctgacaacaggctgttcattaagcaatgattgttcaataaaagaggtggttatgccggcaaggaccgacaatattaattgatggggttgaatacgtgattttagtgatgacagagcgttttcggcgtcttttggcttcattgccaaaatgagtacatccatgtcttcaatacatagctggttcggcaaggcgcctttgattccatattgaagttcaagttcagttaatcgctctgtattgctgcggtttgtaacgcagatgttttgtttcgggattttgttggcacgaacgatacctgatatcattccttccgccatagatcctgctcctataaaggctactttcttttgatcaaagatcggtaacatctcctttgttcgcttttttgttcgcattttcacacgtttaaaatgttaccacgtgaggaaatgatgtcaagtttgaaggtcatcattgatttgtattgtttcttttcgacaaatatgtataatgaaaagcagaaaacacccggttcacactgctgcgccgggtgtttgtttctattaaaaattatctgagagagctttttcaatcagttttttacagcgatccagctctaccttcagctgttttttatatagcttggcggcttcgtaatctttaaattgatagaggacgacttcctggagcttagccccttctttttttactttaatttgttttagtatcccgtcatcaagaagctcatgcaaagaccggtatacttctgtatgatttggtttaaaaccaatctctttaaattcagaccgaagtacttcaagcagctttaacccatagagtctctcttgctctgtcatcgttatcatataaagcttcaaaaatgcgcgctgtttcactaaaaagcctgttgaactccttttttcttctttcatcatatgcactccttcttctgtcactgacaacactatgtactaaatattcaattttcttttattgttttccttctttatattaaagactgatagtccagtcatttcatgtttactgattataggtgtagcggaaaaaataaatttcgactgaacatttggtacatagttttcttagttctattatagcctgcattcactgctatcttcaatttaaacgattgccagggtttacatatctcattttaccggtacggatttcattcaaataaaaaaacctgtcgaaagacaggttttcatttttaaggatttgttgaccataatcccgctgttttgatgaaaatacgaggatctaatttcaattgtgccaccatgtactcagcaagatcctcaggctgcataactttttcaggattaccgtctgttaagttcaattcgatagacatatcactagcgacagtgctcggcgttaacgcgctgactctgatattatgttttctcacttcttgcataagagactctgttaacccgagaacggcaaatttagaagcgctgtaagcacttgttacagcagctcctctttgacccgctgtagacgaaatattaatgatgtctccggctttgcgttcgatcatttccggaagcaccgcgcgcgtgacatggtacacacccattaggttgacttgaataatattttcccactcatcggctgacagatctaagaaaccgccaaatttgctgatgccggcattattaatgagaatatcgatatcaccgagctgttccttcacttgagctacagcttggttaacctgatcggcatcttttacatctgcagcagcaaatgcagcttttacaccaagcgctttgacttcttcagccactttttctacattagcggaagtccggccaattaacccgatattcacgccttctttggcaagcgccaaagcagtagcgcggccaattcctctgcctccgcctgtgattagtgcagttttatgttgtaaattttgcaattgaagcaccctttctttgtttacatatgtacgatatcacattataagtacaatacatccaatacgcaaatcaaacgaactgtgtaaatatcatttcttctgattaaaaaaacggatacagggtaatgacataagaaaaggagtgaacatatgattatagtttatatcagtcttgcagtattagcagtttctattatcttcttaggagttaccgtgattcaaaacaagaaaaaaatggaccctgcactaaaggagctttcctctgttacgcaggctatgcaaaaacaaatcgaaggattaaaaacagaaacagagctgctgacgcaaaaacaaaagaagattcagcaggatgtccaaatgaaaaaatccgcgtttcagcagaccgcagctgaagtaaaagaagttcctaaagccgttaaagaggtgtggcaggctggccatttaaatagcaggtcatgatgaatgatatcccgttgtttcgatcagaatggacaatgggatatcattttttgaggaggctttcgcatgattgtaaaccgcagctgcttaaaggagttcgcagaaaaactacattctcttccctcttcacttacaaagtcggatttacttatttctccatttcatctccatcaagaaaatgaacttgacatctactattcacctcataatgaatatatcaatcggactgctacgattgtgattgccgggatcacgccgggtttttcccagatgaaaacagcgtacgaaacagccgtcgaaagtctgcggcaaggccgcactcttaagcaaatggcggtagatacaaaaatagcagcgggtttctccgggtcgatgagacataaccttatcaccatgctggatttatgcgggctgccgcaagctttcggcattcaaagcgccgcaaagctttttggagaattacggcatatgctccatacaacttccgttattaaatatcctgtctttatccagcaaaaaaactataccggatacaaaccggctatcactcattctcctatcctaagcacttatgcttttggacacttccctgcggagcttaaccatgtgacgggaccagctcttctcattccgttaggaaaagcggccgaaacagtatgtgaaacattgatcagacagcacagcctccagaatttgatttgccttaacggctttccccatccatcaggcgcgaacggccatcgtttgaaacaattcagcaaaaacaaagagcaactagaaacacaaattcgttcctttgctgcattggttgatttcgctatagaaaagaggaaataaaagggatatgataaacaaaaacacaaacgtggggagtggttgaatgtttcctatattagaaacggatcggcttatacttaggcaaatcacagatcaggatgcggaagccatttttgcttgtttctcaaacgatgaggtgacacgctattatgggcttgaaaacatggaatctataaaacaggccatttcaatgattcaaacgtttgctgccctctatcaagaaaaacgcggtatacggtggggaattgaaagacgggacacgaaagaactgatcggaacaattggctttcacgctctggcccaaaagcataggcgcgcggaaatcggttatgaaatcatcccggagcattggcgaaacggatttgcatcagaagtgctttcaaaggtcgtatcttacggattttctgcccttggactgacgcgtattggcgcagttgtatttaccgctaatgaagcatcaaatcgtctgcttctaaaaatggggtatcaaaaagaaggtgttttaagacagtacatgtatcaaaatggtactccatatgatacaaatgtgtactctattgtaaaaccaagagaatgacggcattctcttggtctgtgcgcacatcccctttcctttaaaaagataaaaaacgccctcaaacagggcgctttctaattaagatgcatattgaggagatgattcctccttaactgctttttcctcaggtatatgaatacatttcgtcaagaccgcacttgcaaggtaaaggaccgcaaagatccagacgacgccttgcgcgccgacgagaccgatgaacagccaagcgagtgcagggccgacaaacgctgataaacctgcagccaaattcaatacagacatggctgcccctttatcttttcctgccaccgtcggcacaattgcaccaatcggcacatagcctgccagcaaaccgccccaaataaagccgatcacgctgacaaccgctaagcttccgccggagaaaacaggtgcgtagtataataagagggtgaaaatgccgcagccgactccgccgaaccaaataacagtatttttccagccgaatttatcgccgacaataccaaagataaggttaaacacaatgttccccagaaaaatcgttccccaaatttgcagccacacattggttgagattccatgctgggccatgtgcatcggcaaaaagactggaaaaccatatgtaccaatgctgttgatgattctgatgattccgcctgtaagcacgcgcggatttgtaaataaaatcgtaaccccttttaaaagctcctcggctgtttctgatctttttcttttcttcttttcaaaacggtctttattgataaacaatgcaaagaatgcaccgagacatacccagaaaatagagctccaaagcgtattcaaataaccgaacgctttgatcgcgtagcttgagtaccaagcgccgaacacaaacatgccgaggcaatatgcaatccaaaaccagccgacagcagtgctcagtttgctttgcggtgttctgtaaatgacccatgtcaagaaagaataagcaaaaagcgggtaacctaacccttttacgaagtaagtcacatacatcactggcaggttcagctgttcaaatccaaatacgataaaagcagctgtaccgatcacataaaacaacagccccataaacatcgttcgttttgcgccaaatgcttcgagacatacacccgaaaaccaggaagctatggcaagcgcaattccgtatatactaaaaatagaagcggactgctgaacggtgagcccgttttcgatcaaaaaaggactgagccagccttgttcaaggccatctcccatcataaacaaaacaacccctaaaaatccccaggcaagccgcttcggtattcctattttatccaacatgtctgtctcctccttagatgctcatatcaatcaattaccgtattaccttattaaagttgaaaattaaatgattcctcaaaacagcagaaatgccgccttaaattaatactttgctttctgaacctgaaaaaaagcgctgtgtttgcttccatttctcatataaagccaattctgtctgacagtccttcggttcaatcacctggacatttgctgacatctcctccgttaattgaaaggtttcattgcaaatgactgcagcaccaacgacagatgcctgatgatatccctcttggacatagacctttttttgaagaagatccgcgatatattgagtgagcactttgctttggaatccccctccgcacacccaaacatagtcacgttcaaacggagtaacctctgttaaaatgtcaaagttccatttgattgaaaatgcgatttcttctagcgctgcacgtacaaaatgtgccctctttaaatgtgctgacagcggggcatcaaaaagaaaaccgcctctcgttaatgcattcttttcagccgataaataagagccgagagccgctacacatgcatggtcttcttttgcaagtgcagaaatctcctcctccatgacgtcgtacgtttcattcggataaaaaatctgttttaatttttgataattcaagccggtaattcccggattcgtttccacaagccaatgcccttgatctgtatgacagttcagccaggctttatgttttgtgtcgccatgatccgcactaattttggttattggcgttgttgtccctgatacaatgacaatgtcctcaagtccagctccggtgcttttgacagccagctgtgtatccccgccccctgctataaccttagcatttattgaaaggcctaattcggatgcatattcatttgctatcgttccaattgctgttcccgctcttacaagaggcggaaggatagatggagaaaagccgaaaatgtcgcacatctcttctgaccaagtgttttgcttcacatcaaatagcagggtttctgttgcctgtgatggttcatatgttaatattccgctcagttggtacgtcacccaatcactgatgcttgtaaagcttgcagtcttttcccataaagagggctggcgctgttttaatccataaagcttgagcgcagaaaaaagtgcggttggcaggcggcctgtgcggctgtatatctcttcccgatcgggaatgcccgcctcccactctcggccgcgattatcgatgttcggcagcccgagaaaaggattgccgttttgatcaatcaaaacaatcccctgtctttggctcgtcgatgtcaaaccaatgatgtcaatatcacgcgaacgggatagcgcacgttttgccaaatccatcacctgcttccacagcacctgaggagaaaaataacggctgtccgggtaaagcgtctctgtggaatactcgatgtcctcccgttcaactgttagaacactgccagttacactcacgaccgctaccctcgcattgcctgtgccaatatcaaaaacgagatagcctttttgttttttcattctcttagcctcctttcttatacccctgttttcagtgcgtccttgttatacattgtcggaatattaagagttttttcacccttccactttttgagggcgttattcagtatcgtcacgtgatgatcctccacttcaaatgttgctccagcgagatgcggtgttgccagaacattaggcaatgaaatcaattcataatctgattcctctggaggttcatgataaaaaacgtctaatatcgcacctctgactttatgttcttttaatacagataaaagatcttcacggtttacaacaactgctcttgaagtattgacgaaaatcgcactctgtttcatcagatcaaaatacttccgatcaataagtccaagtgtttcctcagtacgaggcagatgtacagaaacgatatcactgtctgaaaacaccgttttaagagatactttttcatacagcggatgatcgtcttgaatgtatggatcgtaatactttattttacagtcaaacgcagtcagcagttttgcaatcctttggccaaccgccccgaacccaatcatgccaaccgtttttcctgataattcatttcctttaaatttgacataagcctgtaggtaatccctgtcccactttccatccttcagccattgattcgagacgctggtatggcggagaaaggtaatcacatttccaataaacatttcagcaacggcttgtgcattccgccctggtgtataaaaaacaggtatgcctctttttgaggcagctgccacatccacattggagggcattcccctgcaaacaccgacaaatgaaagttcgggaacagaagcaaatacgctgcctgttacctgatcaagctcagtaatcaagcctgtcgcatttgttgcttttagcagctgaatgagttcatcttcccgatatgcccggccttgttccttccaagattgataagcaactgagccaaacaagttttctagctcttttcgtccttcttcgttgtacggtgctgtaaccaaaaccgtcatggtgcaaaacatccttttcatcgtatttttcataaaaaaaatctctttccgaagatggaaagagattcatatataggcgcgctctgttacaggcagacgccggtataaaccttgctttcctatctttcaagctgacgcttgctggaattggcacaataatgttgccgaggtttcatagggccagtccctccacctctctggatagaaaatgttgagtatgtaattttcagaataaagaatacgtttatcataaagaagtctcagattgatgtcaatctcttttttcagaattgacgttatgatccgaaatgttataattcttacaaaatatctaactagagagaggaactgggccatgaaatcttttgccacacaacaaaacggcattttcaaatccgtttgctcgctggactgcccggatcagtgcggattgttaatacataaaaaagacgggaagatcgtaaaagtgcaaggagaccctgatcatcctgtcacagccggaaacatatgcaacaaagtccggaatatgacggagcgcatatatgatgaaaagcggctgactacaccgctcaaacgaacaggtgctaaaggccaagcgatatttgaaccgatttcttgggaagaggcaatcgatacgatcacctcccgctggaaacagctgattgatgaagagggagctgaaagcatacttccttacagcttttacggaaatatggggaaattgacagctgaaggaatggaccgccgctttttttaccgcatggggtcaagccagcttgaacggacgatttgcagcaaagcgggatctgaaggctataaatatacaatgggcataagcgcgggaatcgatcctgaggaaaccattcatacaaaactatttattttttggggaatcaacgcggtcagcacaaatatgcaccaaattacgattgcccaaaaagcgcgaaaacaaggtgccaaaattgtcgtgatcgatgtgcataaaaatcaaacaggacgtctcgcagattggtttattccgataaagccgggaaccgacagtgcacttgctcttggcatcatgcacattttatttaaagaaaaccttcatgatgaagcatttctgtctgagtacacgattggctatgaagagctccgtgaacacgtgaaacaatatgatcctgaaaaggtatcgacgatcaccggtatcagtaccgaagatatttaccgactggcaaaaatgtacggggaaacctccccttcttttatcagaatcggaaacggaccccagcatcacgataacggcgggatgattgtaaggacgattgcctgtcttccggcgatcaccggccaatggctgcacacagggggcggcgcaattaagcataacagcggaattttagaatataacacaaatgccttgcagcggcccgacttattgaaagggcgcaccccgaggtcgtttaatatgaatcagcttggcaaggtgcttttggaaacagacccgccgattcgctctctatttatttacggaacgaaccctgccgtcgtcgcacccgaagcaaacaaagtcagacagggcttgctgcgggaagacttgtttactgtggttcatgatttgtttttaacggaaacggcggcatatgcggacattgtactgcctgcaacatccgcttttgaaaatactgatttttacacctcctactggcaccattacattcagcttcagcagccggtgattgagagatatggggaaagcaagtctaacactgaggttttccgattactggctgaagccatgggattcacagaccaggagcttaaagattcagatgaagtattaatccgccaggcgcttgaccatccagataatccgcatttggcagagattgattacgatgcactcactaagcattcatttatgaaagcaaaacgcgaaaagccgctgtttccgggcgaacttccaacgccaagcggaaaaatagaattatattcagaaaaaatgaaacaagacggcttccctgctttaccgacatatacacctcttgtaaccgataatgaacatccgtttatgtatgttccggggccaaaccataatttcttaaactcaacattttccaataatgaaaaacacatcaagcttgaaaagacgccaaagctctttatcaacacaaaagatgctgaagaacacggaatcgttgatggggcacctgtacgaatttggaacagccgaggagaatgccagctgaccgctgcagttggagaacaagtgctgccaggtgtcgttgtcagccaaggattatgggcggatgaacaaggaaaaaaacagcttgtaaacgcgctaaccccagaccgattgtccgatatgggcggcggcgccacctttttttcaggccgtgtacagattgaaaaggtttgaaaaataatgaaacccggagtatgccaagcccgtataacataacattgacataatggaggcatacacatggacgtttttttaggaattggtattgctttggcaggatattttatcggtgaaggcttaaagcagatgaaccatacaaaaggtagtgaacaaaatgatatcttgcttataaaagaacgggatatttacttttacatcggactttttttaggaataacaacgactgaagcaaaacagttagctggagacatggcagacctgccttacattgaaataaacggaaaaaaatatgtccagaaacatatgttaaaagattggacattcacattagttgaaaaacatcagggtgaataaaacaaatctgaggagagcgagattcattgtcacgctctcctctgtttagctgtatggattgaccgccaccaaaactttgttcgataagcgctgataaaacgataaaccaccatctatgttctttcctcaaacagctcgagatgcccgttccacaacaatagtttgtatattccattgatgacgtgatgatcttgatgaacgtatgtatcgtaaaacacttagaaaacctattcggtttgaatgtgtgctctcattatgtccccatactgcgcctttatccgcggagggtttttaaaaaaatatgaaacctaaagcttttagattcaggcagcaatgttagtgcaataccctttatttttattgacctccatatatctccgattggtaaaactacgttagcctgatttgctttatacgccggaagctgttcgtttataaaggatcagagaatcccataaccagtaaatcactgcagccgcaatacttaacatataataaaaatacgattgcaatgtccatgctattgacgcaggttcattgataacaaaaaacaagaaagctgcgataaaagcaaccacactgtaaatcaataggtacatgacattgaatgttctcgcttttttctgcaacttcatttggagcggaacagcaaaaaggccatacaccacaaaaccgtataataaagcaattgcagccgtaaacaatgcaattatcatatcgccatacataacaaaagaataaaatcctaaaaacaaaccaaatgtaaggctggatagccctaatgtcattaaataatatgatgcaatttttttcattttttcacccccttgtttgatttattcacagtgctgttagtataaattcacaacctttgtatttcttttatcgagatgtcttccccaacgtgctatacgcaatgcgctgataaaaggtttcaaaaatgacgttcttttattagataatacgctggcatgaaaacgcctctcctgattggcgaaagcgcgaatgaaaaaagtgaatgaatacctgatcaacagacaaaataagaagagttgatattcaacacttttcgtaaaggagtgaaaccaatgagtaaaaagggaattcaaaattcaagtattgaacaaatgagaaatgaccatgagactgaaacagcttttaaagcagatgatcccaaaaaacatggttctgatcctaaaagaacgaaataagttcttacccccactaaaatatcaataatctggaggaagtaaagtgactcaaaaaaacggtgcagacagacctgatgattataaaagattttcttcattagacaaggaatatgattttcagcaatctataagcagcaatactaagacagaaagtgtaaacactgaaacacaaactcataacaaagaaaacaaaaatgacacaacagatgttgccgggaaatactttgagccctcagattataaaggaagcacgcaattagaaaaaggattagctgaaactcatgaacaggtcagtgatgactattttgaagggacgatcgatcaaaatttggactagccatacaaacagagctaacttaaaaggtcagttagctctgtttttagaaacaaccacagtaaaagagccaacccccaccgaataggatgggggttgcacgtaagtagcctgtttaatatttaaaacgattaatgactttttgaagttcttctgccaactgagatagagattctgcggcataggagatttcccccattgaatgaagctgttcctgtgatgaatttgcaaccgcttctgtattagcagacgtttcttttgttccagcggccaatgtatgaactgtgtgctgaatcacttcaacgcctgatgtaagctgttgagttgccgctgcgacttcttgtatttgagaagtgacctgttccacaaggttcagtatttcattgaaatttcctgttgcctcttgagaaagaacaatacctgagctcacattttcttgaacaaccttaatattgtttaccgtttctatcgattcattttggatggtcgctaccaccgattggatgtggtttgcagatttatttgtttcatccgccaacttccgaacttcttctgccaccacagcaaatccttttccttgctctccggctctggccgcctcgatcgctgcatttagtgccaacaaatttgtctgctctgaaatcgtcgtgataagcgaagagatatcgctgatttctgctgtgctcgctaccaatgtttgcaatccattgccggctgaatctacagatttatcaatgaatttcatctgatctaacatcttgttgacggacttagagcctatttcagccttgtctctcatcgaagaagaaagatccgctatgttccctgtatttgaagcgactgatgatatactgtctaataattcagtgatggattctgcgctcttttctgtcattgagctttgcttcacattgctgtcggcagccatctgcatggctcgggaaatatgttcagatgttgatttcgattcttccgcgcttgccgataattcttcggaggaagcggcgacttgttcagatgagctgctgatctgcttcacaatttgagttaatgaatgagtaaaagaattaaacgattgggcaagctggccaaattcatctttatttttcacaatgacttttttggttaaatcagcgtcgccgtgtgcaatttcatccagctgcttatttatgcttcttaggggcaccattatagactttaacagcattatgcttaaaacaacgcctaatataactgatatcccggtgacaatgatgatgagccattgactcattttcccattgccctgtatttcatcctttagatcctctacctcttgatccaggcgatcagacagcttattgacagccggatctacgacttcttttcttaatgttctttcttctccaaaatggatggtttctgcttttttaggatttgaagagtaggctgttactacctgctgattcaaagctctatactgagtaaaacttgtcttaatgtcttcaatattggattgatacttctcttcatcaatcaagtcattaacccggtcaaggctctttaagacatcgtctgctttttccttcataccctcgtcgtattctttgtctcctccggtaatcaagaagcctctttcatcatttgataacccggtcaattcatattggatgtgttttatctctttttggaattccattttgtctttaagttcttcattctttttcacagtagaagaaatcataaatactgaggagcctccaattccaataattgaaacaactaatattgatataatccccagcaattttgttttcactttcatgtgtcgttttccctttccgcacaatgtaatggctgaaataaaatatgttcaagcgcgtttaaatccaattcgcttacgcccatgtccataatatcgacacgggttatcaagttttatagtgatattctcatatgaataagcaaattctttacgtctctgaacttacagaaaaacgtaagtcactcttttcgtttttctaaaaaaggcttttcccatctcaaattggctgaacaggctgttttctcgaaaatataatgacaatacgcagcatacatttaaggagcgatacactaaaatgggaatcatcaatggtaaagaattcattgaccgattgaataaactagaaaacgaaatatggtatgatggcgaaaaaataaagggtaacatttctgagcatcctgcatttaaaggaataatcaaaacaaaaagctcactttatgaattgcaaacaaaggatgagttaatacatgaaatgacttattgccttcctggagatcataatcgaatcggcctttcctatctccagcctaaaaccaaaaatgatttgaaaaaaagaaggaccatgattgaacattgggctagacatactcacggaatgatggggagaagtccggattacatgaatacggttatgatgagctttgcttcgtcagcggagcttctaaaagataaagagaattgctttcctgaacatatactagatatgtatgaacaagctgctaagcatgacctttcttttacccatacattcattactccgcaagtgaaccggtcacagtcctattttgggctaagtgaaaaaccgatatctgctaaagtcattgatagaaccgaaaaaggtttaatgattcatggcgcacgactgcttgcaacacaaggcgggttgaccgatgaaatcttggttttttcagcgcctaaatatttctttgaaacagatgaagcttatgctttttcaatcccttctaatacaaaaggcgtaaaattcatcacaagagaatcatttgtattaagcgactcttcctttaatcatcccttaagctcaaggtatgaagaaatggattcaattgtggtttttgatcatgtgttagtgccgtggaatcgtgtgtttttttacgataatgtggaagcagctaaagattttatgacaaaaagctcctttcatgcctttacctttcaccaggttgtcattaggcaaatgataaaaattgaatttctattaggtgttgcacagcttcttgtcgacaccattaatgtttccgaatatcagcacatccaagaaaagctctcagaaatcattgtgggattggaaacaatcaaagcgctcattgacaaatcagaaaatgatgctcagttagatgaattcggctatatgcgcccctgtttaattcctcttcaagtcatcagtacgatcattcctaagctatatcctcgatttactgaaatcatacaattaattggagctagcggaatggtgacactgcctaccgaaaatgcatttgactcagagatacgggaagatcttgaccaatatcttcaagcaaccaatacaaatgctgaagaacgtgtgaaaattttccgtttggcatgggatttaacaatgagttcattcggaactagacaaactcactacgaaagatattttttcggagatcctattcggatttcaagcaggctgtataccagttatccaaagcaggagcagttgaacatgattaaaacatttttacatgtagatgcagaacaatgaaaaaacagcgggaaaagatccgctgtttcgtattttttattcaggaaactgaacatggcccggtacagtataggctttggacgttccgctttcaggcagctttggaatggtgtctttcacaacttttccgcggatgtcagtcattctgactttgagagagcctgtccctaaattcgtactcacaaaatggttatagtccattttctccatgttgatccacttaccatccttttcatattccattttcataacaggatacttgtgatttctgacttggattgctgcccaccacctgctgctgccttctttgatccggtaggtgaaattgccggtgattggggctttgacaacacgccatttaatattgatttttccgtctttcatattgccgattttacggaaggcattaggtgacagatcaagagctccccgagcgccttcgggataaagatcagtaacatatacggttgttttcccttttggcccttcaacttccaaataagagccggcaagtgctgcttttactcctccgtaattgagatccgccggatttattgcagtaatctccatatcggaaggaatgggatccagcaggaaagctcctcctgaataacctgaccctgtatacgttgcataaccttcatgcaggtcgtcatatgctgccgaagcttgcggggaaaaacagaagatcgtcaacaaaaccataccaacaaatgcactcatgatctttttcatatttggtcctcctcaaaccagacttcaaatgagaatcattatcattataagactcaatccatctggtttgaaagaggaaatagattcatagatgattttaaggcaaattcactatcattcatatatcaaatgtaggtacttatgaaaaagccaatacaaatgaacgaatgtgcacttcagccgaatgtcttattttcccctctcaaaattcgcattacaataacgaaatgaaacaggctgttggcctgataacagctacacaggaaaagctatttttccccgctcagtttcaacttagctgtcatcataatgccaaatatcagcacaatcggaacccaaataatgaagtgataaaaatcaggctcagccagagcaacaataatagcccccacacaatacaaaataatagccagtgctcttaacacagtatctcttaagaaagtcttcttctgcatcttaaaaaacaatcggccggatatatcctctaaaagagaagccaaagtgccggtcaacacagttgaagaaatacctgcgatccccagtttttttgctgctgtagtttgaatccccatagaaatgctcatgagtataattagaatgtgcacaggaacaaaagcccggtaataagaaagacaagcaaagacaaacaaaatgaatgcttcaagtgcgagggcttttgtcacagcagaaggccaaagggtattttccgcctttccgaccatcaatgtggcaatgatcacgccgcatataaatccgattagcgcagtcaaggaattaaaaacagtgacctgaatggatttgccgatagctaaccccaataatacaatgtttccagtcatattagctgtgaacacatgtcccaggcttaaatacccgattacatccacgattccagctgttaaacataaaagtgatagcaaggtgtttcgataagctgctgcagtcaacggtgtatcaatcctttcttctattttaattgttagtatgtcttttggcgcaatctgtattttttaagtaacccaacattaattaggaagatagaacctatcattcctttccattaactgtaataataatccccgcaaggaaatgattaaaattgaaaggaagcatattgtgatgaaacgactttgtttatggttcaccgtctttagtttgtttttggttctcttgcctggaaaagcattaggtgcagccgattttccgaacacctcaacaaatggccttttaggttttgccggaaatgccaaaaatgaaaaaggcatttctaaaacgggcacaacgggtggaaaaaacgggcagattgtttacattcaaagcgtaaatgatttaaaaacccacctaggaggatccactccgaaaattttagtgcttcaaaatgatctttccgcatctgcgaaaacaacagttaccattggctcaaataaaacactcgtgggctcttacgcgaaaaaaacgctgaaaaatatttatttaacaacttcatcagcttctggaaatgtcatttttcaaaatttaacgtttgaacacagtccgcagattaacggaaataatgatatccagctttatttagattccggtatgaactattggattgatcacgtcacattctcaggtcatagctatagtgcaagcggaagtgatttggacaaactcctgtatatcggaaaatccgcagattatatcacgatcagcaactcaaaatttgcgaatcataaatacggtttgattttaggatacccggatgattctcagcatcaatatgacggctaccctcacatgacaatcgccaataattattttgagaacttgtatgttagaggcccaggtctgatgagatacggttactttcatgttaaaaacaattacagcaacaattttaaccaggcgattacaattgctacaaaagcaaaaatatattccgaatataattactttgggaaaggcagtgaaaaaggcggcatccttgacgacaagggcactggttatttcaaagacataggcagctatccatcactcaacaagcaaacctctccgctgacttcttggaaccccgggtcaaactatagctatcgtgtccaaacgccggaatatacaaaagaatttgtcacgaaatatgccggatcacaaagtacaactctggtatttggctactgatataaaagaggccctgcgttaaaaacgctgtgcctcattttatacttataggctatttttaagcgatccttgtaactccttcaagatccagcgtcggtcaaactaaaaagcatatgtttttttctacataacttcttaaatggctttcttattataccagtttatcgcaagtaaaaagacatcattgttctgaacctgtattaaatgaacgttcgtcccacaaactattcaaaaacccctaaaaaggatgatggatatgtgcggcaggtttactttgtactctgcatttgatgatattattgaccagtttgacatcgatcaattttttcctaaaggtgaataccagccaagctataatgtcgcaccatcacaaaacatccttgcaatcatcaatgatggatcaaataatcgcttaggcaagcttagatggggacttattccaccttgggcaaaagatgaaaagatcggttataaaatgatcaatgctcgagccgaaacaattaccgagaaaccggcctttcgaagaccgcttgtcagcaaacgctgcatcataccagcagacagtttttatgaatggaaacggcttgattccaaaaccaaaatcccaatgcggatcaaattgaaatcatctgctctttttgcgtttgctggcttatatgaaaagtggagcacacatcaaggagatcctctttatacctgcaccatcataacaactgagcctaatgagttcatgaaagatatacacgaccgaatgccggttatattggcccatgatcatgaaaaggagtggcttaaccccaaaaatacaagccctgattatctgcaaagtttgctgctgccttatgatgctgatgacatggaagcataccaggtttcatcattagtaaattcacccaaaaataattcagctgagcttcttgatgcagaaaatcatatgtagtgattgaaattctctagcaagaacttgtcaaatagctttgttccttaggtgccaatccctctagtaattatgaatatttagtacatagatcaattagttatttttagcatcagtttgaaataattttattatgtaaacttaaataagcaatgttatccctttcatataaaatagtttacatttttataaaatcgcttcacttttctattttgtcagcaaaaaaactgaaccacattaaacttatgaaacctgccgcacctgtgattgcaaatatgatataagcccatagaggtaaatccatacactttccctcctaagaattaaatgaaatttctttcatcttacatgaaggtcttctttcttttgtttatccagtgtaatacttaataatatgttgatgaatgcagctggaaaatatataaatcccactccaagaatgcctagtatcgtacttaaacttactatgtaattctttgtcatcgtttgactgtcaatcaatattagaagtgaaatcaatccagctaaaacacctataaaccaagcatcgccaacagcataagaatcatccagcatccctaaccatcgccccaatatagagctcccaatggcagtcaaactggataaaaatatgagtgctttcatttcttgtcctcctttaaagccaatcaaactggtagaaatcggccattgaatttccattagcgggtggttatcatttccacattaacattttaaagctcattacaatacgattcaagcagaaaaaccctacataacgtatatatagggatttgataaaacacaggccaacacccagctctagttactttaagaccactgtatgatcggttcagtctttacgtaccgggatatttcacaacaggcactttcttcttacgcagagaatcaagcatgactgatccagcattcaagttgctttgcactaattctttaggcgtcaatgccatccactgattgagtgacacatctgcatagcggtcacttttgaacatttctaaaaaccataatgtttctgtaccagtgttttgtatatagtgtccagcattagaaggcacgtatccaacgtcgcctgctctataatcaaatgtgcgggcagtcccatttccgataaataccgtcattcgtccctgtcctgttagataatattgccactcatcgctattgggatgccaatgaagctctctcatcgcgccaggctcaatctgaacaagtgcagcggctatcgtttttgaaattgggaagttagaagaatccacaattcgtacactcccccctggcatttgaattgggggttgatttaacaactcgtgtttaaaggtcatggggacttttccatatggtgactgaatgtcttcactggcgactgatcccggcacattcccttggtagatatagacttgctcagacggaagagagttgaaagcattctccgggacaccgaaatttgcagacagaacgtcttttggtgtgtgtgcaagccaatctgaaatggttaacgttgaaaactcagaaaagtttccatcatcgaatacgagcagaaactcgcagagttccaatccctgtatggaatgcggaattcctgctgggaagtaccaaaggtcgccgggaccaacatcagcaatgaaatttcgtccgtcttggtcaacagcggtgatacgtgcccgtcccaaaagcatataagcccactccgcttgcttatgccaatgaagctcgcggacgcctcccgcagttaagctcatgtttacacctgcaatcgcagtcgaaatcggaagctgtcttacggtgatttctcttgaccagccgccgtgatctaatttcataggagcatcagagaatgaaaatctcaagttaggaatcataccctcatctgtaacaggcggcacaagtatattcggattttgaatatcccgcattatatttcgcgggcctgcatcaatagctccagctccatcacttcgaataggctgtggcacgtttctgtcttcatgattgattggttgttgttccaacagcatgcacctcgttttagaaaatgaacaagattttatttcagcctatgcagaatcttagattgctgtgcctaggaatccgcaaataaaaaagtgaccacgaatgtgtcacaaatacatcaaataagctattttttataccatggcttcttatgtaatttgatttcttctgtctgttttttctggcctgtcctccactccactttcactaatacatcatgtcctatcacttcatcttcaggcatataatcaaaggtggcaatatggtcctccatgcgtcccccacccggcatttcatcacctgtgtactctgataagtcgtactcatctacgttatcatcttgatacttttcgccatcaacatacagagtaattctttcaacaacagtcctcttttcgtccttcttactcccctgccaatacagatttagaaaataattgggtccaattgaagttttgtctgatttttcaaggttagacatccacagtccgtttttcccgttgccctcatatttcactttgtttcctgacaccattgcaaataatgtggtgatacagatgatcaagaatccagcaatgatcaatagccatttcttaatattgttcttttttctcatgtttttccccactttcctaactcgttagtaggaaaatatgatcaaaatgttactgaaaagaaaataaaaaagaaacagatggctgtttaaacttttgacttaaattaaagcgctctctaaagacaagattaaaacttttaacagctcttaaatgcattttttgtttcattgagtcaataaccttaaaatgggctttttatttttataactgaattgactgaaattgaactctaaaaatttcgaaattagagttttttaataatgaacgggctgcacttgtttaggtgtcactgtcattatcagtaaacatattatgctgaaatacgcagtcagtcacaaagtctctattcgtattcaataaagactttgtgatcatcgacaaccatttcactcccatcggataatgtatccaaaaggcctcctctggttcttctctatagtcataaatcacagtcactttgacatttgactcagctatgattggttttccaacaattattttcgttttttcctcaggcaaagtaagagatcgaatcatcaaagccattccatctttactgtctaattaacgccatcttcagtgaatttaaaggtctgttttaaattgcgtccttcttgccccttctgtgtccaaataatcacaacctctaattcagaggccttatctgccagcataaaatgattgaacttcagcggtgagccatcatttaaactttcagctaacattttagaatcttcttttggtttgtcacaattttcatcgaggcatccaaaaagtgaaaatcttgtgattgaatcaggatcatttctatacaattgcacatccactgtagctgctttttcccctatatttttgacttccaaggaatatacttgatattctcctttttgaggtctcgcaaattcctttacattttttgcttcacttacttttactgaccactgttctgttttttgtgtaataggcaacaccgtaaaagtcagggcatgcgcttttgattggcaaaacgtaaacccaactgctgtaaaaacaattacagaaaataatacccttttcacttcatttatccctccttcctttcactggccgctccttaaagaattgattttgagcaatctacaagctctcttaaccaaaaccttacctgaggttttgtctttactgctctgcatttatttctttcggtatccgagatggagctttggggatttttctcaatttgctgtttatcacatcagaagagtatagcgtaataatcatacttcccccatacctttttgcccgaattaagattggttggttatattggttttgaaagcgaaagtcaggacctccccagcttaccgtcgcatcccgtccgggcggtacatatggtacacttctagtatgagaatagcgctgaacgatctgcagtcctgcacgatcgactgcattaaatagagttgaggacacctgacaaattcctcctcctacaccttcagacaactccccttttacaataatgggtgcacttttatatcctttgttccgagttctcattcccacaacttggttaaacgaaaacgtctcattagggaaaacaacgtgattgtcgattgcttttgcagaaagagaaatattgtgtgaacggcttttattgcttgagttaaaatacgtcacgtactgaccaagctgctgcgtactgatgtgagctagcagctcgctgtcaactttcggataaatgttcatttccggcacttctatcttggagggaccttggccataaaaatacgcataaaacttttccataaacgcctgttgatacagtttgtagccaaccctgcccgggacgatgcttccatgatcgttaaggacagcatttatcggctcacggtacactttctgatcaagctgtttgatgaatttactgtatttttcatagtcaaccattggagtgccgggaagaggcattgtaaagtcttcacggttaacagtggcaatcgtccgtccttgctgtgtgaccgttaaactgtcctgcggctcactcggctgagccaataaaaaaagaccagtgatcaaaatttgtatcataagtcggtttacctcccgatcattagtatgaacagccgcttatcctttgatgtatttcttcccatcgtttgtttgaatctttagacgttgataaaagccttcataaaagagcttagctttatgttcacaccgatccctgagctctaaggcacacggttcattcagtcgacaagtttgaagtagttcagcatctcccagtgatgagggatgcttttttgtcttgtcaaaaatgaaaagggtctcctataacaacaataaatcaatccatttcaatatttttttattgagaaacgataaattttttgttacattcaattagacaacaaataaatgaggtgcttgttatgaatcgaatgtcgacaatttttttaaagatagctttggttcttattggaattccaattcttgctttatgcatttttttagtgcctaagatagccaactattcagcggatatatttccaaatatcgcttatataaaatatctcgttttcatctatttgtatgtaacggcgatacctttttactttgctctttatcaagcgttcaaacttttaagctatattgacaaaaacaaagctttctcgggtttgtctgtaagagctttgaagaatataaaatactgcgcagtcactatcagtatcttttacgcagcaggcatgcctgtcttttatctgatggccgagatagacgacgccccgggtatcattgtgatcggattgattattatttttgcttcaatggtgattgcggtctttgctgctgttcttcaaaaactgttaaaagaagcgatagatataaaatcagaaaatgacttaacggtctgaggtgatgacatggcgattattatcaatattgatgtgatgctagctaagaggaaaatgagcgtaacagagctttcagagagagttggcatcaccatggctaatctttcgatattgaaaaacggaaaagcaaaagctattcgattatcaactttagaagcgatttgcaaggctttagaatgtcagcccggggatatattggaataccgaagtgatgaagacacacaggattcgtaaagaaaaaatatgtaggatcaacagaaaaataaagtgattggcggtgagcttatggacataaacttatatccatctagctgctatactaagcgtccctttcatacacgaagaacacaactatggaggaggcatgcatcatgagagcaataaaacaaatcgttcattttggctgggaacaagccctttcatgtttgtttcctgccgttatttttgcctctttggctattacgcaaatcatcccactgcccttcttgccgcggtatgactggctgctcattatctgcgttctcatgcaattgtggatggtgcgttccggtcttgaaacacgggatgaattaaaagtgatcacattattccaccttattgggcttgctctggaactttttaaagtccatatgggctcctggtcttacccagaagaaggatactccaaaatatttggagtacctttgtatagcggctttatgtacgcaagtgtagccagttatttgtgccaggcatggagaaggcttaaggttgaactggttaagtggccgcctttttttgcagttgttccgcttgccgcagtgatttatttgaattttttcacccaccatttttctatagacattcgatggtggttatctgggcttgtcatcattgtcttttggcaaacatgggttacatacgaggtgaatggagctcgttaccgtatgccgctcgcactttcttttgtactcatcggattttttatatggatagcggaaaatatcgctacgttttttggagcttggaaatatccaaaccaaatcgatacatggagtctcgtacaccttggaaaggtaagttcatggctcttgctagtgattgttagctttcttatagtagcatcattaaaacaagttaaggagcagaatcccacaaaggcagagattggtgaatctttttcttagcattcaagtcccaaatagagtgaaaagcaacgttcaaatggttgcttttttctactctgccgctgagtattcatcttcttcaaatttcatcgcaccacgataactgattcagattacaactgctttcaacaccttgacaaactcatgcgccgccggcgttatctcttcaattgaatgtgcgatgacgccaatatcgcgtgtgaccctaggaaagatgtcctttttaatcaattgatgcgggacggatgaaagtgtaaagtttgaaatgatgccgatacccaagttatttttgaccatattaatcaaggtttcggcattttgcacagttaagctttcctttaattcgatgttgtattgcgaaaatgcgtttgacatcgcgatttcatgaccgcctttacaaaaaattaggtcatcttgatatgtttcaaggtcgacatgcttttcaagttttaattcgtcacgctgcggcgggatgacggccaccatatagtcgttacacaatagctgattttcaaacggttcaaatggagatgctgcgatcccgatatcaaccgtccgatcctcaacccatccttttatttggtcagaggttccttcgatcaattctatgcggatcagcgggtagtttgatctgaatgccgcaatcgcctgtggcataatatttgttgaaactgcaggaaatgaaccaattttcaccttcccgtttaacagcttgttttcccggttggctacttgatatattttgctttcaattcccttcatttgcctcgccagcagcaaaatttcttttccgatgtcagtcagcattaaaccatgatgtttatccctgatcaataatttgagctgcagtgagctctccaggttttttatcgctttacttaccgccggctgagagatgaacaattcttttgccgcttctgtaatattcaatttctccccgacttttacaaatatgtgaagatggttcatgttcataaccatttggttatacccccaataataaaaatgtatttcagttatacataaatgtaacatatgatagaaaccagcacgatatttaaacaagaaaggcggcttcattatggtaaaagttatgctgggaatcatatctgtcacacttatttggggttatacttgggttgcgatgaaagtaggaattcatgacatccccccgcttttattttcgggtttgcgcctgttcatcggagcggttcctttatttctcattctcttcatccaaagaaaaaagctttcaattaaaaaagaacatctcaaaagctatatcatcatgagcctcttgatggggctgggctatatggggatcttgacgtatggaatgcagtttgtcgattcagggaaaacctctgttttggtatatacaatgcctatatttgttacggtgatcagccattttacattaaacgagaaaatgaatgtgtataaaacgatgggactggtctgcggcctcttcggactgttatttatatttggaaaggaaatgctcaatatcgataaaagcgctttatttggggagctgtgcgtccttgcggcagcgcttagctggggaatcgcgaatgtgttcagcaagctacaattcaagcatatcaatattattcacatgaatgcctggcaccttatgatgggagccgtcatgttattggtgttttcctttatatttgagccggtcccttcagccgagtggacatatcaagcggtgtggtcattgctgtttaatggcttgctttccaccggctttacctttgtcgtatggttttgggtgctcaatcaaatcgaagcgtcaaaagcatccatggcattaatgtttattcccttattagccctattctttggatggctgcaattgcacgaacagatcaccatcaacattatcctcggcgcactgctgatatgctgcgggatttttatgaaaacatttacattttcacgacggaaagtgtgaatgatatacatttcccctgtcatttgggcttcatgtgacaggagacgactattatgagaaagtcttctagaatcctgacgacagcctattaaacaatgaaaaaagctagtgtctgcatgtgagacattagcttggctggcgtttaggccggtgagaatctagattcttttttattaccattctggctgatcaaactgaaaaccgtatagaccttttactataacatctccgcaatctggatcttttgtcaaaatcaaataatgagtcttataaggcatcgtctcaactcgatcagttgcactcaaatcaaaatgatcccctgaaaagtttttttcactaacggttatttcatatcctgacaaagtcattcgcatgattcttgcattaattgtacatccttcagtatcgaaaatggtgaatctgtactcaaagtgagatgtccaatggtttgaatttaggtcatcagacttcataaaccatttttcattttctgtcattgtaaaactcactttctcctcatctttgacgataacggccgaagcttcccctacatggatagtcaaagccaaaagaaatgtaaaagctaacatcaacatctttttcaaaagagttcctcccgatatctttttacttcaatatattggaagggtcttttctgatcaagacagtcttctccaaatgaatctttagcaccatgaaatgagccttaataagaacagttttaacccaaatcaaactctattcgaattcttttttagagtttctgcatttctttatttagctcctagacacatataaaaaatgctcctataagttcaggagcattacaaaaaactgctaaagtgttttctatcgatttattgtattcattagctcaaagaagtattcaggcttttgagtcttatttagcttataccatgaacgcaatgtatctggtgcaaatacatctaattttttcaatacttctaccgcaaattccagaggagcaattcctgatgcagtaaccaaattttcatcagatactgcaggcccgttttcatataatgtttctcctttgtaattagggcagaccattttcatatactctaggtcattgcttgtgtgctttctcgaatctaagtatccttcattcgcgaggcccaaggttgcaccacaaattgcagcaatagtcgtgccaagctttaaagcgtcgtcaactttttttaagattggctgatgaatatcttctccccaagtgtttcctccgggtaaaatgataagatcttgactctcaagagtacactcatcaagagaaatatctggttttatgcttagtcctcccaacgtagttatcatttctttattagcccctactgtaactacttttaaagatgctgcatcctgtttaaaatatctccctgagtttagttcagcaattaaatatccatattcccagtctgacattgtgtgaaatacgtagagataaacttttctcgtttgcatccaataacactccaatcacaattgataaagccttctaatagatgacctcgctgacagccattttcagcttttttgttgtttcatatgtaatcgcctattcttatataataccatgtaggtgggcaattgccccttgttctcccaacttattaaaaatataagataaattgattctatgtttactagcgcaaaggggtttgttacactaactgtcatgggaaacatttcaaaggtaatacaaaatcatttgaatgaggaggcctgatgaagttgaaaaataaagcgtcaataaaattcggaatatgtgttgggcttttatgtttaagcattactggtttcacacctttttacagctcaacacatgccgaagcaaaatccatagaagacacaaacatggcaagctgtataacgaataaaaaatttgttcaactcgagaaaaaatttgatgccaggcttggtgtttatgccattgatacaggttcaaacaagacaatcgcctatcggccgaatgagcgatttgcttacgcatcaacctataaagttctagccgcagctgctgtcctgaagaaaaactcaattgaaaaacttaatgaagtcatccactacagcaaggacgatcttgttacatattctccaatcacagagaaacacctggatacaggcatgagcctaaaagaaatctcggaagcggctatccgttacagcgataataccgctgggaacatcttgttgcaacagcttggcggccctaaaggttttgaaaagtcactgaaacagattggggatcatgtaacgaaagctaaacgattcgagacggatctaaactctgcgattcctggtgatattcgtgacaccagcaccgcaaaagcactggcaaccgatcttaaagctttcactttagataacacgctcacgactgacaaacgcacgatcttaaccgattggatgcgaggcaatgctactggtgacgaactgattcgggcaggcgctccaataggatgggaagttggcgataaatccggagccggaagttacgggacacgaaacgacattgctatcgtttggccgcctaacagagctcctattgttttggcaattctgtcaaaccgctttacgaaagatgctaattatgataatgctcttatcgctgaggctgcaaaagtcgtccttaacgatctcaaataatatgtttagccttttgccacaaaggaaaagacattacttttttaacccctaccgttcattttttgatgaacggttctttcataggacctctagaatcatatatttaaacaccacaaaattaaacgttattataattaacggcaagttttcattttatggaacaagtaaagtttgacctgacaagaattaagattaagcaccctaaaatccgttttctttccttccaagaatatactccttagtgcaagctattataaagaagtgaacatacaatgcagacaactcccttaagtctcttattctgtgaccaatttgtaatactcataaatatccggactcacttccaatatttcgtctcgaagacactaacatatcaaaccacttgaattggtcttgttgactcagaggttatctatatgagaattcaacaatttttttataataattcatatttttgtatcgttgcacttggtggatttgactcttttaatgtatggaaccacacttttattttttcacctcttttgagatcatctgtgttatcaatctcacttaatcctacaattactatgttatttttaaacttgttcataagttgtccttcagaaagatcgtaatcttcttttactggagcttttgtatcggtaatgagaattgccctttcattgtctttaagcacgacatagcctactaggctctgcatctttgtttcttctccgtgttgttcatttttgcagcctgcaaggaaaataatgagcactatcaagcttactccgattttaggcaactttctccctcccgtcatgttaaacaatctcactccataactgcatatcaataaactgtagtgtaaatctatccagaaacttcttcattttctcatattgaatcttttacaagctgttaatacacagactaaatcgggtaaaaattcgtagaggtgatttctttgaatgatgatcataaagtaactcattactcttcatttattttttcaacaatcatggtatggcggtcgccacctttccacaatacacttcttggtttgtaacagttttcttcttgggttttgcacttatctatacatacgaaaaacataaaacaagttcttcaaaaacaatatcttatatcccgtattttttattcattgtttcattgacttacactttagttaatatgtaatagtaatcctccctttgtgggaggattatttgtttaagcttatttctaggctgcttttgggccacctctatctataatgataaaactatctgaaccatttttttcttccgatctttgtcttcgtaaatagcaacattttggcgtgtcattaatgtaataccggccattttaaactctttttgatctttaaaataaacaacagggacattcaccaaacggatctacttctttttgttctttctcaaatgtttgtatgtggttgtcttcgaaccatacccttactcttattccgctaaaatcgagatttttactttttatgatccattattcacttctaaaaaacttccaattacaacataatatatgtataaattgtaaatggagttgatataattgaagattaggaaaatcttattgagttctgctttatcctttggcatgctaatatccgcggttcccgcattggctgctggcacttcgtctgaggttgcagtaaaaaatgaagaatatgattacgatactatataccgcattagtcctctgccaatggacctccagccaacaatagaatacaacggttatacttatacgcttacacgtcattattttgattactcaatcgggttttacacggctatttatacaaaagttgtttaaacttataaaggagctttttagctcctttttctcttgttttaagcaaggtatttctttctatgtcgtcccctatcaaatacaatatcaacattctccagttctctttgacacgaacaaaatctaaagtttggttttaaatgctggtaataaaaaattcattttaaagaagtgccgcccgcaaaatgcggcttttgtacactacgccaattttatatagaaaagccagacctcctccaagaggttccagcttttcttaatgtgctatcgatcttcgttagttcaacggaactttatcattcggtacaattgcagcctcccgacttctagttagggctgatggggggatatctgatggctctctacacacatcagacattataagatttcaatgtagccttctgtaccgtgaacgcgaattcgttgcccatcttttatcagcttggcagcattttcaacgccaacaactgcaggtaagccatattcacgggctataacagctccatgggtcatcagacccccaacttcggtgactaggccttttatggatacaaacaatggtgtccagcttggatcggtaaaggaggtaactaatatatctccatcttctaaatcagcatcttccatgtttaaaatgacacgcgctcgcccctctataactccggaggaaacaggtagacctacaatcgctccggctgggagattttctcgtttatactcacctgtaacgatttcaccatcagacgtgataacacgtggtggagatagtttttcatataatgtgtactcgtcttttcgtgtactgatgatttgataatccagtttatgtgtgcgcacgacttcgtgaagttcttcaaaagtgagatagtatatatcttctttttcatgaataacgcccgcttctatgagttgttcggcttctttcagtaaagcctgcttataaacgaagtatcgattaaccatgccgtattttggatattccctaaacccgctgaaattccggatgatatctatcattcgttttgtttctttggctttttgttcaccatccggtaattgcttcaatcgatctaataactcttgttctttcttcaaagcttcctgtcgcccttgctcaaatttccgatggccgacattaggctcaaaatttttaatattattaagaatcattgggacaagtgtagttggtttttcgctccatcgagttcttgtgatatcaatttctccggtacatcgcattccgtatttgctgagataatcatagatcgcgtctcgggttttgcttccgccatcaaacttagccagttcatccaaaaaattatcatcttttacatgttgtaagtaatcaattacctctggataaggacgaatcacatctgcgacgtctaatagcgcaagacccatttctgaagtaatattatggggtacagattgagaaagcgtatctgctgcgttttttttcacctaaccacttgttcattttttcgttaatccataatgaagcattcatagcagttcgaatcacaaccgaactttcggggttaaataaaatcttctttaattcctggatatcttccagaataaaacgaaataaatctgatcctgatttcgtgtggatgttttgttttaactcttctatcgatatttgactgctcttaatcaaatcagacacgattgtcggatcgttttcaacttgagccggcatatctgcattgcctctgctgggatttggtgctgttttatcatttggtatcgactttatgaaatctcgtcgctttattatggtcataagtgcgtcttttaagagctgatcgtgctgccccatgccttttaagaaaacttctctgctgtcaggggatgccagatgatgtgtgacatcaacaaatagccttccaccggctttacgcatgggtgcagcagtcgtcaacagaaaaaaagacaatcccagtggttttatgggatccgtcatcatttgttgatgaccaacagaaatatagacgtgattttcttggtcactcgcttcagggatggggaataaagtagtgattggacgactctgtacaatataaaaagtatcgcgggccaaacaccattcgatatcttgaggctggccgaaatgagcttcgatctgtcttccaatgcgtgccagctgtaaaatttgttcattagtcagtgtttgagccttttgctgatcagaatcgatctgctgtgtttctgttccgccttcttttcgtccgtagatagccatttttttagttgctattctcttatcgatgatttgcccatcctgtactttataacaatcggcagataccaagccggaaaccagtgcttctccaagtccaaaaccggcatcgatggataacacctttcggcttgaggtaatcggatcagcggtaaataaaatccccgaagcctgagggaaaaccatcctttgaacgataacggataaatagacttggctgtggccaaatccattttgcatacggtaaataaccgcgcgatccgtaaatagggacgcccagcatttactgatatgctgcaagattgcatcgacgccgataatatttaaataggtgtcttgttgaccggcaaaagaagcatgtggtaaatcttcagcagttgcactagaacgcacggcataggcatgttcctcgccgaactgggagagatagtgagccactgctttcacaacatcggaaggaatgtctacttccataatgatttgccgaatcttccggctgatgttaccaatctgatctcggtcctcaacttttagcatcgccaactgatccaacaacacttgtaacgtttcgttttgttcgatggctttttgatatcctactgttgtgacacaaaatccttctggtacttgtataccttgaacttttgataattcccctaaatgtaacccttttcctccaacgagcgaaagctgtgttttttcaatttcatgtaaaccgagaaccaaagaactcattctacacctccccttcaaaaaataaatattgacaagagcttcccagcaggatataataaaattataagatgggtatctataactttttaaccaggaagcgcacgtagtatgattatatcaccgtgtctgtttttgtgcaatataaaaagaacctgggcaatttcaccaggttcttttcttaatttccgtaactagtcacattaaaaaacttggttcgagatgattcaatcctcttaggaaatcctaaagttgggttctttttggaactaacctgctttattcgtagatccccatttataaattagactttttgtttttaacagtcccacctttaactagtataaagttatgaggatctggttaactaccagatatttttattttgaaaaaggcttatgtttgataaagaagggttatgtaaaggtatctgttgggagcaagcgctgactacaaaaaattgatagcattctcatttaaataccattctattaacctatagggaaagttttaaaaccagatggagaataccctacctccagcaattccaaggccgttcacctagtagaaaacaacctttaaccattactaacgattttaataatcattgattataaaacttctcaaggaacgatcagcagcccgttagctacccctgattaaggatgatctgctaccacactgttacgttagaacttccactactttgatatccttctgtcgccatgacttggtaagcccaattactgcccagattcattccatggctcttccatgcgttaacatgattgctgaaagtgattgtagcgttgcttccggttggtctcttcgactggcgaacactccagtactgcgtaaaagtagtgcgatcgccatcaatggaaggtgcgttataacgtgtagttgtatatatgtcatatgtaccccatcactttttacagtacccttatacgttccagtaggtctataagtaccccatgaatccactacataatattctatgagcggtgatctcgtccaaccatataaagttaaatatccattgccattcggtgcccaaactccggcattatagtttatcgtcctaaatggcgaacctgtagtccaacctttaccaacaacaaaatttccggtattagaccaattaacactgtaattcccgccagacccattgacagcgtttactataccgcccccatcagtccaattttgccagtagtctgtgctagctgcagaggcggttgccgaaaacaagctaatactcattaaagctgccgataatccaactaagaaattctttttaaacttaaacatatgttacctcctataatatttttttccgactttgaggtagcactcgtatatatttaaaacattcttaattactaacgccaaagcttttgatcgtcctcttcagtataataacacgaattcacgagcgaatattaaaagtatttgtaatttaattacaaatacctagaaacacattataagtggtcttcttccaccatatcctgatccttttttcgcaggatcacaattcttgtttctaattcagatggagtaatatctgtaatgaattcccattgaatcttttcgtataaaggagatatatattagagattgtgaagtcattgttgctgccgcttgtctaatgaagggaagcaaatttatgaagaatatgaagaactgaagaagaaaacaattaaggttatactaagaaagaatcgctcaattagaattattgaccaaaaatttgaggatgatagcttaggtcagttttacaaagaagttgcaagattgttatttgaaagggctctgaaaaagaaaaataagaattgacaatcagggtaactgtggaatgtaaccgagcctccaattcaaaataaatttctttaaaatacttattttatttaaagagggactgtatatccctctttaaaattaagctttagattgctgctgaaagtaataaaaattgtacttttgatcaaacccttcttcgctaccacaaagaaaaataatgaattcaataaatgcgataatagaggggataccagtccagcaaaacaaaatatatagaataccttgtcctactcttcccaaataaaacttatgtattcccagacccccgaagaaaaatgctaataatgccgctacaattttgttcttcttgcttaccatgacttcctcctagttcattgctaccgtttttaaagtaacgctttcatattataatgcatttccaccagaaatcgtgaaaattttgaaattcttttgagatatttttattttattgagaaatgaaaactcatataattgaactagatggttttgggaggcgtttattcaaaatgtatggccaaagattacgtcaattacgaaaggcacacaaattaacaatggaacagttagctgagaaaattggaattgcaaaatcaagttacggcggggatgaagctgaaagcaaaaaaccaccattggacaagttggttattttagctagactatatgatgtttcagttgattacatacttgggttaacagatgatcctgatcctaaagtgaaaagaaagaatctaaaagagtttttagaaaaacccgatattcactgggatggatataaacttacccctgaaatattagatcctatacgaaaaattttgaagatggttactacaaacaacaattagtaaagtccgcataagggcttttgcataaaacaattattttattgaattttctggctcattttaagaagtttattcatgatgatagctaaactttcaccagctttttgtggcttctcacctgtttttatcagagtaattaaagcacttaaaaagtccactaagctattttgatttatttcaactgtttctttataagctttgtaagcttcctcaaactaatcaaattgcacacccttcatagcagcaacagcaaatttattgaaatatttccatatgactctgttaaactaaaaaatcttttgacattgattagtaagacaatgcactttaaataatcgtaccccagaccaatatgtaaattgcctgcagcaaaccaaaactgtgtacggttcaccattccttgcaactgtctcaatccctttgtataagtataataaaaagacaaatgaatttttatctgtggaacgctcaggtaataaggacactataataacttactttaagccaaaacatccaaataaaaaggctggttataattattataaaaatcaataggaactataaatatataaagagggattgctatgccaaaattatatacatgtttaatttgcggatataaaggattaagtgaaaacccaataaacaatgatggtgagtatcaaaaaacatttgaaatctgcccttgttgcgattttgaatacggctacagtgaagatcatgaagtaagcttaggttttattgtaacgccagattacttaattgaagctgcaattcagttataccgaaaacaatggattgagaatgacatgaaaattgcaaatcctaaatatattccagatgaattaagaaacggtgactgcttaaaatttgaggtgttgttaaagcaattgaatagcctaaatctcgatacagaaaactttgaaatcaagggatttaatggttattaggcagcttcaagcccccggtatgggggctttcttattattgtaaagactatcagaagactatttaagtattaatatcattgattattctttctccatattcccctgaccaacacttcaacttctttaacctcaactgtttgctgcatcacatccctcctttttgtttttcgtgtatcaagcttgtacaatgacatcatcaagcaattcaacatagatcaattcttacctgaaggtgaatatcacccaaactataatgtcgctccttcacagaacatcctgacaatcattaacgatggatccaataaccgtctgggcaagcttagatggggccttatccctccttgggctaaagatgaaaagatcggatacaagatgattaatgctcgtgccgaaacactggccgagaaaccaagctttcgaaagccacttgtcagcaaacgttgtatcatacccgctggcaggtatacagaataccgttctgcattttcttcccgagcttccacccactcatagtcacccaccgtccagaaacgcggtgaagcttgaccgtctctgtcttgatatttcaactcttgctgaagttcttttaaaaactgaatatcttgattcattcatttcctcctatctgtttaaaatctcgattttaaggtaactttaaagtacatggtcttgagaaattcccctttaattggtaagctggcacctaggatcatacaaagcaggtgataccttgaaaaaaataatcggaataattggattaattgcttccttaattgtgcaaggattttcagcaagcggttcgttgactcatgagattgctatggcttgtctatttgtatttctaataatttataattttgaacatgctaaggatttctctaaaaaatctctaattgttttaggagcaatctttatagctctaatgctaggtatttatcaactcatttcctttagcggtgattactttgataggcttgacttaaatattggacttatcatcttacttgaaatcgctttgattattgttttggtatctattgcagtaaatttaatgaaacttattgcgaatcggttaaggaaaacacctcatggtaaagagttttaactcattgccttgtggtctcttatgtatgaaatcaaatgctttccctaattccttctcttctgttacgctgagtaataacaattacttgccatatcttatattgcataatacggttaatcagtcgagatcattgagggatcaaaatatggccaaataaaaaacgatggatgctccatttccattaaaaagacaaggttgaatatgtagtacttcactcagaacatttggcttattaaggatataataagtgttcttattaattttccctgttacgataacgatcaaaaacagagttatctatcccatttcaagccagaaattattctgcttttttaaaatgttcttgattttcacttttatatatatccataaagcattcggacataaccattatatgtaactgaaatgcaggtataagacttattatatagagatttaactaccaatatgtggggtctattaacatccaaatactcaaaagcaagaacaaatgtactcatagccttccatttccacaccttatccaaattttcattttcctaatttcattttaaatcgccctatttcacatcgtaatcgctatcgtaaaagcctatattatcaacgtttttcctcctgaaaaatttcccttttttatcaatatctccttaaaacaaccacttttccctactcccacttacgttttatcgtttacccctattcactaattaaagtatcaaaaatccttatgtttactgtcttttttaactcattataaatttttacgataagcatgttattcgtgtacgttatacgacttgactgtatttggtgacgatttaacagagaaatttaatgcacttctaactttttaaactgcaatgggtatcattgttgactcaacaactcaaggtatttctgatagtaaacaagcaatggattatgattcaccgagataaaacccctacccttctcttaatcgagtgagagagtatgacaaagctgctgaatatattgaacaagcagtctcattgtacgaaaacgataaatgtgaccttctccctcatacgttatttacactgacacaaatttacttcaaaatgaaggatattgaaaaagcctttattctttataaaaaaggaatcgagaaagcacaagccattaacgatgatgtcttagttgctgagtttaattacttaaaggctttatatatcgactctatagataaacgcacagttttccgaactttttctgtacttaaagataatgtaatgtatccagatttagaggaattagcactcgacacggctaattattgtaaggagatagggcaatttgaaaactcaaccaccttttttgacgtcatggtggatgcccgaatccaaatacaaagaggagagtgtttatatgaaatttaaacttgcattagccaccttgtcagttgtcgttggattagcaatttttagtggcttttcatcctcgaatgacaaagagttccatgaagctaaaaggaatattacttctattcaaccgaccaagttttttgtttaatatttaacccattagaaacattaccgagcaatgggtgctactaatttgtcaactcttgattaatcattagctaattaaactaaaaagaccgcactacgaaatacagtcagtgtggtcttttgtcttcaaaataaaattttaatggaaagtttgttaccacatatgcaaagcaagaaacgaaagcccccatgctaatatgccgaacattacgaagaacctaagaaaagtttcatattttgtaagtcttcgttctctttttattttactcaatctccaataaaaggcgtagccggagaacaataaaattatttgtcccagttgtgacacagattctaaaaattctatcccattcattgattttcacctcgtttatttatgagaaaagcaggttttattactcagatgaaaaaaccatttccaactgtttaagtaaaaataagtaagccatactatgtctaatggtataagaaaagatgtcctctgtgtctagtaaaaccatagtgtatggtggcagaatacgttatgtttctctattaaaataagcaaattaacattgcagttttatcatcttaactttatgatgtatgtccacaagtcagccctgctctgtgaagcgcagtaccagcagatgtataagaaactgctctaagaatcgctttcgaattgttttggctcggtgaaatccaccaccaagatcatctttactgtatccaatacccaggctgattgttcgaccagctttgttgtctgcacccttaccggaaaactcggtgtcatctaggtcagctacagacttaaacgcttttttaagcttcaccatttgcgaccttagttccttaaactctttggttcttttatcggcctcaaagagtaatgaatcagcctcaaataccttcatatcattctccttcctagactactctatgtaaattttaccacagtaatctatttgaataacagaaaaagacagccaaaatgactgtcttatacatcacacactatcttgttctataatcattttctgcggtatagtagcgccaatcccaaaaaggttccccattggccaatatataccggtctaaaaatatttcaaagtttacatttaatggattatattctaaaccactttcaaatatatagagatagttgggatcaccttcgttcactttatctttatcgatcattaaatggcattcttccaataagtagccaattggaataccattgatatcttcaaacaaatcctcatattttaactcctcttcaatctcttcaaggctaaatagctgaagtcctccacctatattctccccatcagaaagaatctcaaaaattttcgcgccgttatgcagtgtcatgaacttctgataatcctctggaagggtaatctgatgtttagcttcaaagctttgaatgtcgttaagggttgctttgtccggtgaaaaagtaacaaggcattccatggtatctccttcagaacaaaacaattgaatggctcctttttcatctaaaagacttttcaagccatttaccgtcttatgaacaaagttagtcacatacatcacccctttatttccttttaacaataaccctttcaaactccaaaagttgtggacagatcgtgataggcgctcttttcaatgaatataatgcaataaattctaaaaagaggtgcctccaaaaattgaattctctaatgaatgatgacatggtaaagatcattagaaatggccttagcgcatcccagcatccaaagcatattcttgttgtaggagctggattgtccgggcttgtatcagcatctttgctgaaaaatgccggtcacagagtaacgattctcgaagcgagcggcagagcgggcggccgtgtctgcactttgagagctccctttagtgatgatttgtattttaacgctggcccgatgcgcataccgaataaccattcgttaaccttagaatatataaaaaaattcaaattgccaacaaatgtatttatcaatagaacccctatggacatcatttatgcaaatggaatcaaaacacgtctccaagtttttgaacgagctcctggaatattgagatacccagttgcaccacatgaacaagggaaaacgtctgaagagctgatgctttctttactgcagcctattctaaattttatcaatcaaaatccagcgagaaattggcggattgtcgaagaacaatacaaaaattattcgttaagctcttttttaaacacgtatttttcatatggcgcgatcgatatgatcggtgtacttttggatatggaagcgtatatggggatgtcccttgttgaagtattgcgggaatctatctttttttcatcgcccgctcacttctatgagataaccggcggcatggatctgctgcctcacgcgtttcttcctcaattaaaaacaaacattctataccatcaaaaaatgatgaaaatgtctcagggtgaaaatagtgttacgatccattgtcagcatcaacaaacggcagaattcacatcattcacagctgatctcgctattgtaaccattcctttttcaacattgcgatttgtaaaagtcgaaccataccattcattctcgtactataaacggagggcaatccgtgagctaaactatatcagtgcaacaaaaatcggcatagagtttaaaagccgattttgggaaaaagccgggcagcgcggcggcaaatctattactgatctaccgattcgtttttcgtattatccaagcagaaatattggagcaaatggacatgccgtcattctggccagttatacttgggctgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcgggaggttttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttagatcatgctcaccttctgtactaaaagattattacatttcatataataagatcttgattagacggacaaattcaatcacaaaaacaaagtaatccttgcattccttcgccctccatgctatattcatatagcgatgagctgaattgtgtaagccgatgtacacgcctttatggcacacacgaatgtggcgtgtggtgcatcgcctcaatacgcaaagacgtttgccttaggcaaacgtcttttttgtgttatccgatttttgtgccgtttgaaacaggctgatccggctgcaaaaggacgacatcgccctggccgggtatgccgccgaggaccaagacttccgatttaaatccggcgatccggcggggcggaaagttcacgactgctatgacttgcttgttgacgagaccttccggctgataacgcttcgtgatctgcgcgctcgattgttttatgccgatttcagtcccaaaatctattacaagcttgattgccggtactcttgcttcaggaaattcttccgcttttacaattgttcccgttctgatatccaatttctcaaagttttcaatgactgccatatcaataactcctttttctcctattgtaaaggagatattcaagattcgtttaaccaaatagccattattttttatctgaatataaggtgtttcgatacaggcggggcggcattcctgtcctttttgtgaaccatctggtaaaagaagaaaggttttgaaagcccagcgccccgctcacgaaggtaagggtttcatttctctccatcagcattcgttttgcttcctcaaggcgaaggtcggcaatatagttctgcggggacttccctgtctgttttttgaaccagcttgaatagtaagctgggtgataatgctcgatttctgccagcttcttaatcgtcagccgctcaaataaatggctgtgaatgtatgcaattgaggcatagctatgggattgaagcttttcttttatgtattgtactagcatatgaagcgagttggctgttccggcctttgcttcctctgtcagcaagtacctgatcgaagaccagaaaggatcgagtgcagcttcaattcccgatcctgcacgaaactcatcaattttcattgcatgaagcggaacatccagtacaagacattcatttcttccgatagaacggaagcgatgctcgcactgcggcggaatatataaaaaatgatccggatttaatttcacctggcgcccctcagtctcaagatctatactcccttcaagcggaaaaagaaattggctgtacgcgtgcttatgtgaatgatataggcgtgtgtatgtccgtttttcgcaaatcatctcttgaagcgaatccatcagcaacccccttcctttggtcatcttttaatccggtaatggtgttccgatataggcgaaaatccgattttttcatataaagaaactgccgccagattttctttcatcacttgtaaaaacatgcgttccgctccgttgttttttgcccattcagtcaacaccctgatcacttgggttcctgccccttttcctctgtgctcctcagctacaacgatattactaagtccgccataaccatcaatgacagaaaccgtgccaagcgctgtcaggctttctttgtcatacatcttgaaaaaagttttacacggcggcatgcgttcgaaaatgtgtttgtaacctttgtgacgctcgggtgaaaacccttctaattgaataaattcatctatccaaacagatgatggctcttgttcccacttgtatgtaaatcggctgttgtcatttgttcggctcataattgaccggcacaacgctgtcatctggaagcactcgtctaccttttcataacggctgtctgccaatgcgtcatcaagccctttcggtgatgcgttgctaatatgaaaacaaacaggtaagcctaaactttgataaaaaagttcggcctctagctgaaaatccccttcaggcatatccgcagacgtccatacgctatttgcccttttggttacgccaaaattcgctctgagaagccattgccctatgcttttttgaaaataagccggccatgaagctgccgctaatcgttcaatcttgtgaatgtcatccattgcataatgcctctcccctatgtatactcccttgatattatacaatattcagaaatataagacatccatttatttgtttacataatatttttattgtttattaataatcctgacaaaaatgtcctaattgaaaatgacaggctttctaaaatgtcctcctcacgttcaaatgcttcttttgcgattaaagcagtaaagccatgcagcaggcttctgagcccccttgtcgcatgaatggcagtcttttcacttgcatagccgttttcaatgaacagcttcgtcacaagacagacaatttggtcagagacgatttccgcccttttgtcctgaaccttaagcagagccgcttcataatatccgggattttcaattgcaaaatcaacatatgcatgagctaaagaaagcatagcggaatctccctttcgttcggttacggagtccgccatttgatcaaaaagctttgtcagtcctctgacagcaagttctgctctgatcgcttgcagcccgttgatatggttatacaatgacggggggcgcacattcatttttttagaaagtgccgcaagtgagacaccatttaccccttcctgatcggcaatctccgctgcagtgtctacaatcatttttttggtcaaacctattctcggtgacattgctcatcatcctttctttgctttttggatcgcctgtctcatccgctctgaaggtgatcgcaggaattttccatgtccgacagcgagacaggaaggcgccttatcggcgagcaattgtgcgcttttgatggcctcctccttattccatgtagcgaaagcgggaaaaggaaacgtccattttatctggcctgaaacagcgattcctccgcgcaactgaaacgcatctcctgctattaaagtgccgtttcttgtatcaagaaatgacatgctgcccggtgtatggcccggtgttggaatggcaagcagggaaccaattgtttcaccgcccgtcagcagttggtgaggctttgtttgtatgtgtttcggaatacctccttttataggcgtctgcggctcatcttgccgcaaggatgtgtcaccttgaagcaagaatgaatcccgttccgagatcatgacctttgcatgcggaaatgtttgtgccaatgtatccagtgatccgacatggtccccatgtgcatgagtcagtaaaatatgctgaagcggttttccaagctgattcacagcttgaataatccctttatagctgcctggcagtgcggcatcaataagggtgacttcgttttcttcctctactaaatagcaattaaccggaaacaatgctggaaaaaaagtcagctgccaaaccgtttggtactgagtaattctcatctttttattcctcctaacaaaaactaatggtgttagttttattattaactaacaccattagtttatcaagagtttattatttttttatcgctacataaatgttaacttgtgctcgctgtggcactgcggcactttgatcatacatctcaaagtcacctgtaaacgtgcgcagatgccgcttatcccaagtccaaatttccttccacgtttcaagcacaatctcttcaatagggccgattctggaagtgaaaacggcgtaagcggaagccggcaaattaatgttttcatatggttccggaagagtactgctgtgttcctgaaacgttccgactgaaaacgtataaaacccattcgtctcttgttcataattcgaatataaggcaataatgctcttgtctttttcagcctgtgataaaagagcgctcatatcctgcttccagaattgatcccacagtgccggaatcctcctttcttccgtcatttccagtgcgttgcttgtccgttgtgacagtccggcaaatcgtttccggtctaagtgtgttatatgtgaaaagcccatacgatctcctccttttgttaagattatagacaaagaaacctgacagcagtgtgtcaggtttcatatattttttgcatgtgatgaatggtttcttttactttatcccgtatatgaagaggctgcagaacctcaatatcctttccgaactggagcaaaaaaccgatcagccattgatcttctggaagtgaaatcactgcccggcagatttcatcttcctcacaacagtgaaggacatcatatccgaaccattcacctatacgctgacgtgctgccggctgaacaagaataaccagttcagttaaacggcccttctggtaccaattcttatcccatggcaaagtatccagctgaatgtcttttctgataaaggtttgatgtaagatggccagatctttcatccggttcagtttaaataagcgaaaatcatttctcaccaagcaataagcgtataaataccagtgccccgccttgcaaaccaatgtataaggttcagtttcacgaagaagtgtttccccgcttgcgcttgtatatgtaaaagatatcgttgacaaccgatcgatggcagcgcttattttctcgcgcagcgtcttttgatcctcagtatggccccaagccgtcatgtcaataaaccatttttctgtttggtgcttaaatgcttgagcagattgctcaggtataaggtgtttgattttttgataggctgtgctgtgagaaacgggttcatacatagatgaaacgctctgcaacgcggaagcaattgcaaacaattcctcctccttcagccactctctttcaagccgatacgtttccatgatgccaattccgcccccggaaccctgtgaggtcacaatcggaataccagccctattgatcgtctcaatatcacggtaaattgttctgacagatacttcaaacagctcagcaagctctgcagcctgcacttgttttttgctgatcaataatacaaccatcgctaacaaacgttccagtttcattctgcgcaccttttcttcttgtattttccaacaaaacaatcataacattttgataaagcttgggcatatctattatgcggcggaatacacctcgcatatgctatgaaaacaggggtttcccttcttttttgtgttcagtattttatttcagctactatttccaaccggataagcatacacttctcaacggaggggatttcacatcatgcatcttacttttcagagcgtttatcctgccatgatcatcatcttttttctgtataaaaaaattaaaaggtccatcggataccagccgctgaagccccgctggctgttcacccgcgtcattcttttctcgctgtttgcttttggcctttcaatcttcagcgccattcacccttttttatatggatatctcattttgggcattcttggcggatggctccttgtctttttcgctaagaaaaacatctcctttgaaaaacgcagaggaaagatctattttcggactcatatttgggtagaaatgattctcttaaccttattcctgtcaagatttctatatcgagtgacagagctttatcttacctcgcctgatctaaacagccttggatcttacagtcagtcaatcggaacggaccctctgacaataggcgtcttttttctgatagccgtttattatatcggtttttcttcttttgtcatcaagctcagcagaaacgaactcgaacagcacggacacaataaagaaaaagacatccttgcccgctagcagcgagttaagcaaggatgtctttttcaatcatgctgtgtatgatggatcatttgctgaagaacatctaaaacatgttcatcctccggagagtaataaatcgatgttccttctctgcgcgatttgacaagtcgaagattttttaaaaatctaagttggtgggacacggtggattgcagtaaattcagcttttctgcaattccgtttactgcatgctcaccctgggacaataaatggagaatcctgattcgggtaggatcagaaagcgctttgaatgtttgcgcgactagaaacagcgtctcctcgtccagatcagcagccgattgttccgtttctctaaattcagtcatatgtatcacctttctttattcatagttttatcttataacaaatgcgcttgagtgcaaaccagcctgcttgtattccatttcaatctcatagtttaaatttatgtttcaaatcaggtttttacttggtctgatataccgtcttatgtcataataaaaaaggtcatactgctccaaacattgagggtgaaacacagtgaagaaaaagagaaaaggctgtttcgctgctgcgggttttatgatgatttttgtctttgtcatcgcctcttttttattggtcctgctttttttcaaccgggatttaatcaaaaaacttccgatcgatacgaaaacgattgttttagaacgtttaaccgattacaaacccttggtggaagaagagcttgaaagccaaggactctctaattatacatcactcatattaggcatgatgtatcaggagtcaaaaggaaaaggcaatgatcccatgcagtcctctgaatctctggggttaaaacgcaatgagataacagaccctcaactcagtgttaaacaaggcatcaagcaatttaccctcatgtacaagaccggtaaggaaaaaggcgtggatttggataccattattcaaagctacaacatgggggcaggttacattgattttgtagctgaacatggaggaacgcatactgaggaattggcaaaacaatactccgagcagcaagtcaaaaaaaatcctgatctgtatacttgcgggggaaatgcgaaaaatttccgctatccgtattgctacggtgattatacgtatgcagaaaaagtaaaagaaaaaacaaaaactgttgaagaatctttgcaggttgcaacacttgaaaccatggaatccaaggctcatgaataagagtctatcaatttactgacaaaagcccaaaaatgaatttgggcttttgccatgtttacacgtaaaaaaagccatactgagtatggcttttaataatacggtgaaatcatcaaatatacaataacgcctgtaaggcttacatacagccatagaggcattgtccatctcgcaatttttttgtggcgctctacctgcatgctgaagcctctgatcagcgtaaacagcgcaagcggcacaataattgcagaaaggcagatatgtgtaattaaaataaagaaataaatcgggcgcataattccttctccgccataaagcgtgttttccgcaatcgagtggtacgtcacatagcaaatcaaaaatagtaaagttgttgtgaatgcggccaaaataaagcgtttgtgagctttgatatttttctgtttaatcataatcagcgcggccaataagaagataaacgtaaagctgttgaatatcgcattcagcattggcaaaatgtgaatattcgcatggctgaactgatctaatttaggcataaaaaacagcactgcgattaaaccgttaatcagaactgtcagcgtaaggacaattcccgtgtaatttttcggtttattttctgtttggttcatttggtgacctctcctaatttgtactggctatccaaatcgtatgcaaattcaaagaagatgtcaacggtttcgattgcttcgtcagaaattagacacacttcaaaggccggaggctattagccccggcctgttaggtttacgcctcttttatcaaatgttcaatgaccttatgttcattttcattcagcaggttcttttgaattttcgaatgaatgggtttattcatatgctgatccaagatatcggccgtttctttatccccggcgataaccattcgttcccatcttttcgcggcagctttttgatcaaggctggcagccagccgcttatacagtctcgattggttctctgttacatgttccctcatccggttctcttcaaatcgtgccgctttgtctacagctgaatggcaattcttccaagattcattgatcatatcatactcataacactccaccgcctcaattttccctaaaacggtttcaataattttcacttcatgctgctgagttaaaataaacgccgtacttgggtatgtctggcgcaaaccctttagctgatccaggacagctgtttcttcccagtaaaatcttgtatctacagggacttgaagcttaataggctcccatatgccgctgtcggaaacaaaaaacacgagactgcggggcatgtcttttcctattgcattcaagtattgattcattttagccctgattccatccagacacttttcctcctctggatcactaactgccaaatactcttttaatcggctgaatcctgactttagggcaatcttccattctcccccctgctgctctggatctctcatgtctgtattgagatacagggagagaattttatccggcggttccaattggacatactgtaatttgttaatcaatgaatcaatcgccattctgattcctcctttttcacaggttagttttctttttcctctcttaaaaacgatcaaacctgactttccgctaatttctagtaataatggaattgttgtttacaatacgcctctcttctaatacaattggtaactgtgtttctaagctgatttttgaaaggagtttgatcttgtttactattaaagaaaaaaatcgtcaagagcttgaagaggaattaaatgatttagaatttcaaatttatcgcatgcaggagaatatgaaggatttatctaaagatgccaaagtgcttggtattgatcaatcgaacaatgaagaatggatgattgtttcctcgattgatgatggccaaacatgcaaaattatgctaactgattgtaaaacggcttaccgaggaaaaggctgtttttcacttgtagcgtcttacaaggacgatgccattcatataggcgatataaaaggccctccgaatcacgggtttggttccatttgcatgaaatatttaaaagatatagcaagagaccacaatataccgaaagtcacaggagacatcgccaaacgggattggaatcatgtagaccggctgattcacttttatgaaaaacatcaattcaaagtatgtatcgatcatgatacccaatccggcagcattaagtgggttgatttgtaaaaaagtctggaagaaagagccaagatatgctgtaatggtataaaaccattgatggagggttctatgtacgcctcaaaactgaaaatgggagacgaaatccggatcgtgtctcccgcgaccagcatgtctatattatcaaatgaagcaaaaatccaagcaaaaacggcgttagaacgcttaggttatcgggtaaccatcgctgaacacgcaaatgaatgtaacgaatttgattcatcctctatcgagtcaagagtccaagatctgcacgctgccttttttgatccaggcgtcaaagcgattttaacgacactcggaggatttaattcaaatcagctgctgcgttatcttgattacgagaaaatcaaacgacatccaaaaattctgtgcggctattccgatataaccgctctttgcaacgctatttatcaaaaaacgggtcttgttacgtattcaggtccccacttctcaacatttgcaatgaaaaaaggactcgattatacagaggagtattttctttcttgctgcgcttcggacgacccgtttgaaattcttccttcaagtgagtggagcgatgaccgctggtttttggatcaagaaaacaggcgtttttatcctaataacggccctgttgtaatccaagaaggttatgcggaaggcactttaattggcggaaacttatgcacgcttaatttgctgcagggaacggagtattttcctgaaacagaacatactattttattgattgaagatgattatatgtcagacatccacatgtttgaccgcgatctgcaatcactcatccacctccccgctttttcacatgtaaaggcgattttgatcggcagatttcagaaagcatcaaacgtatcaatggatcttgtaaaagccatgatcgaaacaaaaaaagaattatccggcatcccgatcatcgcaaatataaatgccggacatacctcgccaattgccacgttccctataggaggaacatgcaggattgaagctatttcgggcacatcacgaatatggattgataagcattaatcagcttgtaaatttttttacaagcttttttagcgcaatcggttatgcatgccgcacgagacatgacaaatgtcatataggaggcatgatgtgtgctactacaaaagacttctctcattagcgtatactgaaccgagacacacaatgagaggatacttactatgactgaacaaaccattgcacataaacaaaaacagctgacaaagcaagtcgctgcatttgctcagcctgaaacaaaaaacagcctgattcagcttttgaacacgtttatcccattcttcggcctgtggtttcttgcttatctcagcctcgatgtctcctatcttcttacgttagcattaacggtgattgccgcaggttttctaacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcaactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgcaaggaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagttcattttataaactcccgaaactgcttcaatggctaacaggcaatatcggttaccaccacgttcatcatttgagtccaaaggtgcctaactataagcttgaagttgctcatgaacatcacgaaccattaaaaaacgtaccgacaatcaccttaaaaacaagcctgcaatcactcgcgttccgtctatgggatgaagataacaaacagtttgtgtcatttcgggctataaaacatatacctgtaagccttccgcctgattcaccagaaaaacagaagctgcggaagaatgcctgatgataaaggaggtcttctaatatactagaaggcttcctttttattgttggagggtgcattctggctttcacaatgataaagttacaagtaagatgaaaagctgaaaatgaggtaagatcatgattaaaaatcattttacatttcaaaaactaaacgggattacgccctatatatggacgatatttttcatcctccccttctactttatatggaaatcatcatctacatttgttattattgtcggcatcattttgacgcttttatttttttcggtatatcgatttgcttttgtctcaaaaggctggaccatttatttgtggggatttttattaattggcatttcaaccgcctccattaccctgttcagttatatttattttgctttttttatcgcgtattttattggaaacattaaggaacgcgtcccttttcatattttatattatgtccatttaataagcgcagccgtcgcagccaatttcagtctcgtattaaaaaaggaattctttctgacacaaattccttttgtcgtcattaccctcatcagcgcaattttattgccctttagtataagaagccgcaaggagcgcgaacggcttgaagaaaagctcgaggatgcaaatgaacggattgcagaactggtaaaattagaagagcgtcagcgaattgcccgcgatctccatgatacgcttgggcaaaagctttctcttatcgggttaaaaagcgacttagcaagaaaattgatttacaaagatcccgaacaagcagctcgtgaactgaaaagcgttcagcaaacagcgcgaacttctttaaatgaagtaagaaaaatcgtttcctctatgaagggcatccggctcaaggatgaactgatcaacatcaaacaaattctcgaagcagctgacattatgtttatctatgaagaagagaaatggcctgaaaatatctcattgctgaatgaaaacattttgagcatgtgcttaaaggaagctgtcacaaatgtcgtcaaacacagccaggctaaaacttgccgagtagacattcagcagctctggaaggaagttgtgattacagtgtctgacgatggaacattcaaaggagaagaaaattccttttcaaaaggacatggcttactcgggatgagagaacggcttgagtttgcaaacggaagccttcacatcgataccgaaaacggaaccaagcttaccatggcaattcctaataattcaaaataaacataaaggatggcttatatgattagtatatttattgcagaagatcagcaaatgctgctgggcgctttaggatcacttttaaacctagaagacgatatggaagtcgtaggcaaaggtacaaccggcctagatgctgttgattttgtcaaaaaacgccagcctgatgtatgtattatggacattgaaatgcccggaaaaacagggcttgaagctgctgaggagctaaaagatacaggctgcaaaattatcatcttaaccaccttcgccagacccggttactttcagagagctattaaagctggcgttaaaggctatttgttaaaagacagtcctagtgaagagctggccaacgccatccgtagcgtcatgaatggaaaacgcatctatgcacctgagctgatggaggacttatacagcgaagctaaccctcttacagatagagaaaaagaagtgcttgaacttgtggctgacggtaaaaacacaaaagaaatcgctcaggaactcagcatcaaaagcgggacggtgcggaattatatctcaatgattctagaaaagcttgaagtgaaaaatcgaattgaagccattacccggtcaaaggaaaaaggctggtttaaataaaaaaggatcttggcatctgccaggatcctttttgttaacctgaaattcccgtttgagaacctcgccgcaaccagaattaaattgatcgatatcctcgctcctatacccgctgaacgattgcttggttaacagcccaataaaagactggattgaatgatatccctgttaaaatggtcggccattgcacatcagcagaatttctgatattgattattttgtattttcagtatgacaaagttgtgccacttcgctcccgaagctgccatgcccaactgcaagagcctaatatcacaataaaaaaccgtctgaaatcaatccgattccgttccgtaaatggcatctgctacatccaactgcttattatctgccaaaaacaccagctcgtttcgctgatcaaagatattaacaaccagctataaatgtcatgatgccgaatgtctctgtaatgtggaatcaatcatttaacccgagagcccctgaatcgcacataaagagaaaaacgggaccactttcttttatcagcatatgatataaacagctctaagcagaacaaaaaaagacacaagccaaaagctcatgtcttttatcacaatctatattattagtttaagactttaacacttacagttttgacgccccaattagaagcatcacttttacttggtacaaatacgtcgattttatttcctttaatagcgccgccagtgtctgctgctgttgcttccccgtagccttcaacatagactttagaacctagcggaattacattaggatcaaccgcaataactttcgcgttcgggttcttatttaagtcaatgcctgtagctgtaacgccggaaatgccgccgtcgttagcagtgtaagcagtagcagtaactgttagttcttttgaagcttcttgattatttgtatttgattgaacagccttctcctctgtgttaacagaagtttctgcctcagcctttgtttcttgtttaggttgctgttgtacagcttcttgtttaggttgctctttttgcacagcctcttgttttggcgcagcttgaggtgcgtttgtttgcgcattctcagtagctgtgtttgctgctgttgcctgaccttttactgaaagagttgatccagcatagatcatgtcagagcttaagttattccaaactttcaggttgttgactgtcgtgccgaatttttgagcaatcttagaaagcgtatctcccgctttaattgtatattgcccagtcgtggttgtttcttctgaagaaatggtcagtttttctcctgcaataattttatcagaagttaacttgttccattcttttaagtcctttaggttcactccatttttctgagagattccccagagcgtatcacccttttgcaccgtaatttcttttgcagaagcgtgagctccgaatgcagttgttgaaagtgcagcaactgccacaaaggacataatcgtcttcttcataagtaaatcctcccttgttagctttttattggcggctaacaggtgatatcgtaacacacgtaaatgtcaaatcaataacaaaaagatatgatttagattacagttcctttacatgaaggatttctctctgatggaaagacttgctgaacccttgatataataggcttcgcaggtctttttattttgaggcaaaacagagaaaataaaatgtgttttttatagaaaaaaagattgtttttctgttttttagtctgtcatccttgcataagcttgtatttcttgtaaaaaaagccggccgtattttgctcttttttgttctccgactccttttatagacaaaagttcatcatcatttacgggctgttttcctgacatttcttttaacgtttggtcagagaaaacaacaaatggcggaacaccctgctcagccgcaatttctttccgaaccatgcgcaatcgttcaaatagctcgtcattttcagtaatcgctgccgcttttaacgcttcttttctcgctactgataattctcctttcagcacattccttcctttactgctgacaaaaagagtcggaaacgttccgtctgacatcctgatgaagtcgtcagaaataagaaattcgataaaatcactgatttcgccaacggattggtgttttaatatcccgtatgttgaaaggtctgaaaagccattttcaagaacttttttatttttggagccggcaagcacctgggcaaccatcgtcttgccaaaccgttctttcatgcgaatgatacaggataagaccatttgcgcctcccgcgtcacgtcatgggccgctcttgtatcggtacagtttccgcactgtccgcacgcatcaggctccttttctccgaaatacataaggataaaacgctgcagacaatcttccgtatgacagtagtcgaccatttgtctcagtttttttaaatcctgcttttgtttctcttcatgttctgattgctcaattaagaagcgctgcaccataatatcctgcggtgaaaacaggagaacacattcactggcaagaccgtcccgtccagctcgtcctgcctcttgataatagctttccatatctttcggaatttgtgcatgcagaacaaatctgatatttgatttatcaatacccattccaaaagcagaggttgccaccatcacttgaagctcatcattaagaaacctttcctgctgctcttttctctcatcatcagccatacctccatgataccggcctgccctgacctgatttcgtttcaatctctcatatatccgatcagcttcttttctggtcgctgtatagacaattcctgcttcatgcctgttgttttgcacatattcgtctataaaccgatctttattttctccttttactactttaaaggttaaattctctcgggaaaatccggtatataccgtgttttctttttgaatatgcagctgtttgcaaatatcatcatgaacctcgggtgtggctgttgctgttaacgccatgatgacaggcttgtcgtgtaattcacggaacaagatttcaatattcctgtagcttggcctgaaatcatggccccattgagaaatacagtgcgcctcgtctattgcgaccaaaggaacatctatgccctgcaaaatccggataaattctgtggacgttagtcgctctggtgtaatgtaaaaaagcttataagccccttctttgagtccgttcagcctctcatatatttcctgattggattgtgtgctgttaatgtaggcggcgttaatccccgcttcttctaacgcatcaacttgatccttcatcaaggaaatcaacggtgaaatgacgatcgtcgtcccttcaaacattagtgccggaatttgatagcaaatcgatttgccgcctcccgtcggcataatgcaggccgtatttcgcctcgcttccgtcaccaagcggatcgcttcatcttggccgctccgaaacttctcataaccaaaataatgagccagaagggattgggctctatgtaacataacgtgtaaacctcgcttttccttgaatttctcccatcatatcataaaaaagcggccttcatttctttcacacaaaaatggaatattcactataccaaacctttttagataaaataaaaagccatttccgaaaaggaaatggctttcgctacgtcttgccgtatgcaagtaagaaagttttaaaccaccactcctcaaagtgggtgtttgcagaaacgttcctgtcgtcctctgcaatggaggcatgacattccggcttcgatataaaactccctattacagcttaaaggttaaaacttaattaacaatacgcacaaagtagcttctttaatatagtacaccatcaggcggttttaatcaagaggtcagaacaattgtttagaaaaactttttccagtgaataaaactgctttttctccaaaatacctgacaattcgacaaacaaaaaatatattacaataaaaaaaacagcctttttcgctaaaagtgaatgattattttcttctatattaatgtgtatatacaaaaagactcctatttgtaacgataggagtcttggctttattagaattttgcagcaagatcttttgcttcttgtaaacctttttcaacgatttcttgcgcttgatcaggtgctgcgttatgtccttcgatgacaactgtgtgcaagtcttgaacaccccagaaaccaagaactgttttcatgaagtttaatgacatttcaagtgcagccattggtccttctgagtagacaccgccgcgagcgttaagaagcgcaacttttttgcctcccattaaaccgactggtccttcttgtgtgtatttgaatgtaacgcctgcgcgagacagataatcaacataagtatgaagcactgctggcactgtgaagttccaaagcgggaatgcgaaaacaactttgtcagcttttacaaactggttcagatatttgtcagcaattgctgcttgttttttctcatcttctgtcatttccattccttgacctgctttaaatgttccgttaatcatatctctgccaaggtaaggaaggttttccttatgaagatctaattcaaccacttcatcattagggttgttttctttataagcagctaagaaagcttcgtaaagtttagttgaaacgccttcttcagctgtacggtcgcttgattttacaaataaaactgtagacatttgtattcctcccggtaaactttttatatttacttacaaatagtatgttactttcttttttacgcaaagtcaatcactttattttgaatatgagattttttttcaaaaaaaagcaagtacatctaatatcggtgtacttgcttgccatttttacttcgaatcttgttcacgatctaagatttcatacgtctgcgagcttttttgatcaattgtttctttgttggataagtcttttacctgttcatgaaactctctttcataagaaggagcatctgtctccagatcatcctccacatcagcttgggcctcaactgtcattcttgcataaggaacagcttcaagtctttcgtaaggaatctcttgaccggttttttcacacacgccataagttccatctttcatcttttgtaatgcacggttgacctcctctaacagctcccggtcaatctctttcactgtttggtctgtcatccggtctgtgacgagcgtcccgtgatctgccatatggttgtcaaccccattggaaagctcccccacttcttccgtcattgattctgtttcctttttctcgccagacaattctttttgcatatcgagcaatttatgatagagatgctgtgtttgttcttttgtcagtgccatgtatatcctctcctttctatcctgtttcccgttttgccttctgtcaaacatgggaacatcgatggaaagatgagctactgcctttttgaacggatcgtgaccgctggcgtcgatggtgcttcgggttttcgttggcactttttgttcttctcttctggcggtatataataggttgcgcctatatttaatctgccgctcagttcatcaatggtcagctcgccgaattcaagatgatagtcaattttttcgacattcagcgtttcaatatgtatataggtttcttcagattcctgtttgctgctttgtttctgtttctcaagcactgaaagtctttcttcacattcacgcagtttgtcaagttctggtttcaagcaatgcctgatcagcgaccggaacatttttttcatgacatcacgaccctttgcatactcctctttcgtctacatatataatgaggtatatcccatagaaaggagaggttttcatgcttccgactaacatcaatatttctcatctcaagactaactcgataggcaccggctcatcccttacctttggttctgcggagttaaggaacaggtgctctgctatcaaaagaaataacggttttggggaacaaaatgcagatgttattgttatggtcattccgattgaatcaattgatgaccgtgatggggcagatgcactcagtatgaaaatcaatcatcaataacaatggttttcgcttgaccttcgtctttttgaatggtgatgtataggattccgtctttaaaaatggcattcatctttccatgaagatggtcggaaagcggaattttcttttcaaaacttccgtatttcccttctttttggcgaaagtcctgttcattaaaataggaaaagcgctgccccttcaccactaaataatctccgtacgataatatgtgaacgtcttgtttacggtagcctggaagataaattaaaaactgcacttccgtaacggtatctacaatatccatgctcggaaatgaagcatctcctttccctcgctgatcttgctgcgcaaacggaaacggagattggccatttgtcataaaaggggttttttggtcttcatcaaatacctgtttccaaaagtcaccgccatacatctgctgtgcgaattccatccactgcttcatcttttcgaaatccatttgaagccccctgtcttaacatactttataaccgccagcatacaactatagaaaggaggtttgcctgtggttcaaccaactccgtatatcaatattaatattttcatgctgaaaattaattcctttgaaaatgcttcagcggttaacgtaggacaaaatttattggcagaatggcaaaattcagataaaaaaaatcaaggctacggacagaattttggagatgcgagcggatttatgggcacgagaagccatgtggatgacagagaccaaattgattctccggcctcttttgaaagtgaagcggttaactcctcaatcaaaaggaagtgatgagatgttcttttcaccctccgtcgtgaatgtcggcggatttaaaatcaatacgatggaccgtggttcctctttaacactcggtccgtatcagcaggtcgattactttttatcagctaaaataaatcaagggtttggggaaaatggcgactttactcctcttgtcgtaccgatttcaaatgtattagatgcagatcttgttgattcgaactcagcgaaaaacagtgtggtgtaataagaacagggcgcacatgccctgttcttgtttttatatataaaaaaagcctaaccattttttgaacggctggctcatcaaatattcagctgcacaaatgctttgtcagcaccgcctgaacctcgcttaaatcggtgtctttcgcaaattctaattcgaacgttttgcttcttgtcatcaataaaagcccagtgtccggatcaaacattcccgcttcttggatggcaaagctttcaattgttttatatggaagaaatacacgaaccttctttttagaaaacattttattgtcaaagaaaatgatccgcttatttgtaaagcaaatttggtccactcggagcttataaatcgattctattctttccccttcaacgagcaaagcctcaagcttctttgcatccgttgatctgctaacagaaaaaatacccaatgaagaacccctctttctgcatttatctatttgttttatcattcactacataaaaataagtcctttatccctatataagaatacgacatagaagacatttaaaccattacgaacagattacatttttcaaatttttgatttgttttttggcttttaagctgttgtcatcaagtaatacgcacatatagagaaaaaagtttcaatattcagcaatgtttttataaaaaagtggtttttaatgatttttttaattttgttttatatttcctgttttaaccacaaaaaaaccgcagctgagctgcggttttatgtatcgactgcttttaacaaaatctgtttgatgcttcaaggaagcattacatctcttcgaagtattctttataatagccgccgactttattcgtattgtcgaccacaaagagaaactcctctgtttcattttttacttcatattcttttcccggcgttaaaacgcggtttacgatatatttttttgcgtttgtctgcacacactttacttttttaattgtttctttttcaagccaatttttatgaatcatgatgaaatctccttttcttatctataagtttattgtagcttttttcttttgtaaattgcaatatcggttattcattgattttgccttgatttctattatagaatgtttgtatacgcttacgtttgaagcaactatcacagcttatttctgctattcaatccaggaatcaatgtgctatcaccaagaatctcagaacagaccataaaaaatgactggaggtttgttacggatgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagctgttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgaaacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttgaaaaaagccatcccgggcgctttaaacggtgtgatgtttaaccagggtcaagtctgctgtgcgggctcacgtgtcttcattcataaagaccaatatgatgaagttgttgatgaaatggcatcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatactttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcggccggactatggacagagaacgtcaagcaggcacactatatcgcggaccgacttcaagccggaaccgtttgggtgaactgctataatgtgtttgacgcggcgtctccatttggcggttataaacagtcaggactcggacgagaaatgggatcatatgccttggataattacacagaagtcaaaagtgtatggataaaccttgaagactaacatgtatgtttaaaaaactgctgcctgccagcagtttttttctttctgtaatggcagtaaaagacgctgaatatatatgcttctgaaggagttgagcgtgatgggcacacttcaggagaaagtgaggcgtttccaaaagaaaaccattacggagttaagagacaggcaaaatgctgatggttcatggacattttgctttgaaggaccaatcatgacaaattccttttttattttgctccttacctcactagatgaaggcgaaaacgaaaaagaactgatatcagcccttgcagccggcattcatgcaaaacagcagcccgacggcacatttatcaactatcccgatgaaacgcgcggaaatctaacggctaccgtccaaggatatgtcgggatgctggcttcaggatgttttcacagatctgagccgcacatgaagaaagctgaacaatttatcatctcacatggcggtttgagacatgttcattttatgacaaaatggatgcttgccgcgaacgggctttatccttggcctgctttgtatttaccattatcactcatggcgctcccccaacattgccgattcatttctatcagttcagctcatatgcccgtattcattttgctcctatggctgtaacactcaatcagcgatttgtccttattaaccgcaatatttcatctcttcgccatctcgatccgcacatgacaaaaaatcctttcacttggcttcggtctgatgctttcgaagaaagagaactcacgtctattttgtcacattggaaacgcgtttttcatgcaccatttgcttttcagcagctgggcctacagacagctaaaacgtatatgctggaccggattgaaaaagacggaacattatacagctatgcgagcgcaaccatatttatggtttacagccttctgtcacttggtgtgtcacgctattctcctattatcaggagggcgattaccggcattaaatcactggtgactaaatgcaacgggattccttatctggaaaactctacttcaactgtttgggatacatctctaatcagctatgcccttcaaaaaaatggtgtgaccgaaacggatggctctgttacaaaagcagccgactttttgctagaacgccagcataccaaaacagcagattggtctgtcaaaaatccaaattcagttcctggcggctgggggttttcaaacattaatacaaataaccctgactgtgacgacactgcagccgttttaaaggcgattccccgcaatcattctcctgcagcatgggagcgaggggtatcttggcttttatcgatgcaaaacaatgacggcggattttctgctttcgaaaaaaacgtgaaccacccactgatccgccttctgccgcttgaatccgccgaggacgctgcagttgacccttcaaccgccgacctcactggacgtgtactgcactttttaggcgagaaagttggcttcacagaaaaacatcaacatattcgacgcgcagtgaagtggcttttcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacacccgtcagttgtgaaaggcatgcaataccttaccgacagcagttcgcatagcgccgatagcctcgcgtatccagcagggatcggattgccgaagcaattttatattcgctaccacagttatccatatgtattctctttgctgactgtcggaaagtatttagattctattgaaaaggagacagcaaatgaaacgtgaatcttatcaaacggagatgttcaattggtgtgaagccctgaaagatcagattcaaaagcgaggtcagcttgaccagtttgaagatcaaatcgacaagatgattgaggctctggaagatgaccaaactacagaagaagattggtataaacaggccgctgccctttatcgggatattacagaatcagatgatacaagtgaaagacgcgcttatgtccctatagggaaacacgtgctgccaaagcttccttacaaatactccgccttagaaccttatatttcacgcgatattatggtccttcatcatacaaaacatcatcaaagctatgtcgatggcctgaacaaagcagaatcagagcttaaaaaagcgagagcaacaaagaattatgacttaatcactcattgggaaagagagcttgcgttccatggagcaggccattatttgcacagtattttttggttttctatgcatccaaacggaaagcggcgtcctacaggagcattgttccaaatgatagacctttcatttggaagctattccgcttttaaagaacattttacccaagccgctaaaaaagtggaaggcgtcggctgggccattctggtctgggcacctcgatcaggacggctggagattttaacggcagaaaaacaccagctcttcagccaatgggatgtaatcccccttttaccgcttgacgtatgggagcatgcctactatttgcaatataaaaatgaccgggccagctatgtagaccactggtggaatgtcgtggattggcgcgaggcagaaaaacgttttgagcaggcaaaagaagtcgtttggaagctctattaaaaaaagccccctttcccgggggcttcgtgttttaaaaaatccctaccacatgcaaaaacacgatgataatggcaacaggagatagatatcgaatgagcagcagccaaacagcaaaccactttcgtttgagattggaaccgcttttcagctcgtcaaacaaatcctgtttcggtatttttagcgggacaaaaatcgaaatcagtaacgcacctaacggcattaaaatattgctcacaagatagtcggcggcatcaaaaatagacagatgaaatatagagacgtcacttaagacgccgtatgataatgcagacggcacaccgacaataaaaatagcaattccgcctaaccaagcgaatcgttttctcttattgacatcgcctttcgaaagtactgcgaccaaaatttccagcattgaaaaagcagatgtcaatgcagcaaataaaaatagaagtaaaaatgctaataaaaagataattccgaacggcatttgattaaacacagtcggcagcacgttaaataacagaaccgggccttggtctggtttgaggccgaatgaaaagacagctggaaaaatcgcaattccggccattacagcaacaagcatgttcataacagttacagatacagcggactgtaccagattttcctgtttctctaaataagcgctatacgttaccatgacagatacaccgacacttaataagaaaaaggattgtcccattgcatataaaatggtattggcatcaattgcagttaaatcaggcatcaggaaaaatttaattccttccatcgcgccatcaagtgtaaccgaacgcaccattaaaatgatgaataatagaaaaagcgctggcattaatacttggcttgctttttcaattccgctgcttaccccttttgcaacaactaaaattgttaccaccataaagagcagctggcctcccacagccaaataaggatttgaaatggtacttgcaaatatcgtatcaaaaccagatgtttgcgataaaccgccagtgaagccttttataatataaattaaaatccatccgcctacgacactgtagaaagatagaagaataaagcacgtcaccatgcctaaataaccgatccaatgccacttcgttcctggagcaagtgttttataggactgaacggcatctttctgtgttcttctacctatgatgaattcacctaacaataaaggcagtccgattaaaaccgtaaataaaataaaaataagtaaaaatgcgcctcctccactggttccggcaacatatgggaatttccatatcgcaccaagcccgatagctgatcctgccgcggctaaaataaagccgagcttcgaagaccattgatttgcttccttcaccgtatcactcctatttgatctaaccattataaaggttcattgtaagaatatcttcctatatagtcaagaacattttaattagtttacatcatatatctatagacatctgccaaaaactaatattgaattattcagaaaattatttataataagagaatgttatgaaatttgtaagaatttctgctgaagttcttgataagtgtgttaggagtgtttttatggacatcattagaaaaataagtcattttgcaggacaaacctttggcatatgggtcattgtttttgcagtgctgggattttctttcccatctttatttacgtggatcagttcttatattacgatttttcttggcattatcatgtttgggatgggccttacactgcaagccgatgatttcaaagagctggtcagaaagccttggcaagttattattggagtaatagctcagtatacgatcatgccgctcgttgctttcggcctcgcatttgggcttcatcttccagctgaaatcgcagttggtgttattcttgtcggctgctgtcccgggggaactgcatctaatgttatgacattcttagcaaaaggaaatactgccctttctgttgcggttacaaccatttctaccttattggcacctgttgtaacaccgttgttgattatgctgtttgccaaagaatggcttcctgtctcgccggggtctttgtttatctcaattttacaggcggttttatttccgatcattgcaggtctgattgtcaaaatgtttttcagaaaacaagtggcaaaagccgtacatgcccttccgcttgtttctgtcattggcatcgttgcgattgtctcagctgtcgtcagcggcaatcgggaaaatctgcttcaatcggggttgctcattttttcagttgttatcctgcataacggtatcggttatttacttggttttttttgtgcaaagcttttaaaaatggattacccgtctcaaaaagcgattgcaatcgaagtcggcatgcaaaactccgggcttggggctgcacttgccacggctcatttctcaccgctatcggccgtaccaagcgcaatattcagtgtgtggcataacctttcaggttctatgcttgcaacatattggtcaaaaaaagtgaaaaagaaacaagctggatccaaaagcagcaatctatcactttaaatatgcatcaaaaaaggtacatcactttatcgtgacgtacccttttttattatccttctaataaaagctgttcaggatcttccagtaaatttttgattgtcacgaggaagccaaccgcttctttaccgtctacaatccggtgatcataagataaagcgagatacatcatcggacggttttcgaaacgctcttcatcaattgctactgggcgcagctgaatcttatgcatgcccagtataccgacttgagggctgtttaagatcggagttgacatcagtgaaccgaaagtccctccgttggtaatcgtgaaggaacctccctgaagctcgctaagggttaatttattgtttcttgcttttttcgcaagctcgccgatctctttttcgattcctgcaaatgtcaggcggtccgcatctcgtactaccggtacgacaaggccttcatcagccgcaacagcgataccgatatcatagaatttcttaacgatcaactcatcgccctgaatttccgcattcaacagcggatattttttcaatgcagccacgaccgctttcgtgaagaaagacataaagccgagcttcacttcgttttgctcaaagaattgatctttgcggcgttttctgagattcataacagccgtcatgtccacttcattaaatgtagtcagcatcgccgatgtttgctgcacctctacaaggcgttttgcaatcgtttgtctgcggcgtgacattttttgcacttcgaccggtttatcaaagctttgctgtgcttttggagcctgaggctgctgcttttgctgaggagccggttttgatgccggtttttcgtacgcttcgacatcctgcttgcgcactcttccaagcggatctccagttggaacttgagacaggtcaattcctttttctctcgccagcttacgggccgacggagaagcgatcgttcttgattttgcttcagattgtgcttcctcgctcacctcttgtgcagctggttcagcctgtttctcttctttcacgctttccttgctttctgctttctctgtaggagcaggggcagaactttcacccgcgccttctgaaatcgtaccgataatttctccgacctggacggtatcacccgaatctttcaatacctcttgaagtacacccgattcttctgctgtcaattcaacattcactttatccgtttctagttcaagcagatattcaccctgttctacatagtcaccaggctgctttaaccattgggctattgttccttctgagattgattctgctaattcaggtaccttaatttccgccattttttcatttcccccttagtttttgcgagtcaagctatcagatacaatacgttcctgttcttttttatgaactgtcggatctccctctgcagggctggatcgtcttcttcgtccaatatattgaacgcttactccctctggtgcaatctctgtcaaatacgggctgatataaccccaagcccccatgttctgcggctcttcctgcacccaaacgatttctttcaggttcggaagttttgcaaataactctttgactccttttgccgggaatggatacaactgttcaattctcgcaatgtgaagccactctttaccgtcttctaacttattaaaatgatcactgatgtctatagacactttaccgctggataatacaagtctggttactttttcatagtcatgagaaagtcccgactgttcataaacaggctggaagcggctttcgctgagctcctgcacttctgacaccgtatttgggttgcgaagaaggctcttcggcgtcataatgacgagcggtctgatttcttcacgaagcagcattttagcctgtcttcttaaaatatggaaatactgtgccgcgcttgtcaggttggcaaccgtccagttgttttctgctgcaagctgcaagaatcgctcgattcttccgcttgagtgctcaggcccctgtccctcgtaaccgtgcggaagcagcatgactaatccggatttttggccccatttcgcgcgtccggcagaaataaattggtcaaaatacacttgagcagcgttggcaaaatctccgtactgtgcttcccacaaaacaagcgtttccggtgaatgcacgttatagccgtattcaaaaccgagaaccgatccttcagacagcgggctgttatgaacagcaaatgatgtgctgcagtcagataagtgatgaagcggcacaaattcttcgcccgtctcactgtcatgaagcacaaggtttctttgggcgaacgttccgcgctcggaatcctgtcctgttaaacgaatcggtgttccgtctttcaaaattgaagcaaacgcgagtgattctgccaaagaccattccacttttctgtcatcatcgaacgccttggcgcgtctttctaaaatgcgctttagcttgccgaaaacattaaatgactccggccagttgatcaattcgccattcagcttgcggagcacatcaaaatcaatcgaagtgtccacatctgggaaaccgtttgatacaggctctggaagttcaatttcacaggcagtgtgttcctttttagacggaactttctgatatgcatcttcaatgcgcttcgttaccgatttttcgatgttttgaacaacttcctcggtaagtacgccttcttttaccagcttttcagcgaaaatttgtttgacggtcggatgctttctgacagcatcatacagcattggctgagtggttgacggttcatccatttcgttgtgtccatagcgtctgtacccgatcaaatcaatcagaaaatccttgttgaatgtttttcggtattcgaccgcaaacttaacagctgaaagacaagcttcaggatcgtccgcattcacgtgaacaatcggaatttcataacccttggccaggtcgctggcatattttgtcgatctggattcagcgctttctgttgtaaatccgatcatgttattggcgataatatgaatcgcaccgcctacttgatacccttttaaagaacttaaattcaatgtttcagctacaattccttccccagggaatgcagcgtctccatggattaaaatggccagcgattttgtttcatcttgtaccgggtatccgctttgtgttcgcgtttcctgtgccgctcttgtgctgccttcaacaatcggattgataaattccaagtggctcgggttgttcgctaacgtaatgcgcgctgattttgtttcagcgtcttgaagctcccgattcgccccaaatggtatttgacatcccctgtccatccgtagctgattccaatggatccctcagacggtacaagatctttgttcggcgcatgctggaattcagagaagatgatttcatacggtttgccgagcacatgtgccaagacattcaggcgtcccctgtgcgccatcccgatgttgacacttgtcgtgcctgatttgacagattgtgcaataatgtcatcaagcactggaacaagagcgtccagaccctcaatggaaaagcgcttctgcccgacgaatgtgcggtgcaaaaactgctcaaagccctctacttcagtcagtctttccagcacagccgacagtttttcagctgagttcttctggaacagctcgccagattcaatctttcttgtcagccactcgcgctctttgaagtcatgcacatggtcaaattcaaaagagatggttcttttatacgtatttcgtaaatactgaatggcttctaaaccgttcgtaatgtttttaggagcgtctttgcagatgacagacgcaggtattgcttttatttcctcttctgttagcccgtaatcggataatggaaaaagttcgctctttttcccatcctttctgagcggattgacggaagcgttcaaatggccataggttcggatatcttctgcaagtctgactgcggatgcgatcttttgaatcagatcggctgtaacacgtcccttttcttttgttcccgaggcctcttttatatcgcttggcggagcaccgagctcgtcgaacatttccttcaaatccgggtcaatgctgttcggatcctgggtatactgatcgtaaagctccagcgcatagccgaggttcggaccgtaaaaatcttcccaattcattcgttgtttcatactattttgaaacatttgaatattacccccaacttaaataatcaagtgattgattcactatcttgaaataactttcgaacgctgtgtccaaaattatgtaataaaaacgcttccaacgatattttaccactgtttgcaatttgattctaccttgattgttcacaaaatagtaaaaaacctttataaaaaacaaaaaatttaatcattcgaaaaaacaaacgccaaaaagcataggattaagggctatcctatgcttttatgaagcagttttttcagcagcggatacaaaacatccggtagctgatcaacatccgggacaaatatactgaattttccgtacatatcctggatcgtcttcatttgcgattcttctatttctgagttggagagaaaaacatttatcacttctattcctctttttcgggcttcgataaccgcctcacttgtatcaacgatcccattttgttcgtagccaaatgcggccggctctccatctgagaaaacaattaagaacttttgcgcctcgctgcgatgcagcatttttttcgtcatctgcctaattgcgtacccgtcacggttatcttcttctggctcaagctgcataatggccggtccagactcttgtcttaatgatgattggaagggaataaccgtattgaaatagtttggctggcttgtttcggttgcatcatttgtgtcctcccagaacccgacaatctgatgcggaaccgctaccgatttcaacgcttcgtgaaacagcacgattcctcgttttgtttcgtccattttgtcgaacatgctggctgaacaatcgaccagcaatgtaaaaactgcgtcgatttctgaagatggttcttgctttttgtagaacaggcgcggatttcgctcagtgaagtagcgaagaagcttattgttcagtctcccggcatgaagatctgttctcggcaatgtttttttatgttcaagcgttttttgaatcatttgtttcaaacgcttttgatacgattcaatcgtttttgcctgctgtttataagaaagctcttcttcactggttgccggctgcggttctttataaattggaaatgcatatttattttctttgccgtcagccatccccgctccgttcggctggtctttttgggactccagcgcttccagcttggaatagtctttccgtttcgtttgtctggctgatccttgaacagagccaagggcctgatctccatcgtcgccttcccttgaagcatcttttcctaaatctgattttgcgccgtgttcaatatcaaattgaaggaagcttttggacggtgcttctgtttcccggtgccatgtcggcatttcttcttcatggatatcctcatcaccgtctgattgttttggaagcgtgatgtcatcactcagcttcggcgcttttttctcttcttcaaataacggctgttctgcagcttttgcgtagtcaagctcaggcaaaaagaagtaggtgttcaacatgtctttatcgagcacctcttcaagcccgtccatgaggtcctcaacaattttcagaacctgccgtgtcgaatctgcttcatacacacgcaagagctgctgctcaataaacgggcgcatcagatcgatatcttcacgcatggacggaagggtctcaagcggcgattccgctgtgagcttgacatagatcgcgcaaaagagcgcatcggtaaaaatgcttcgttccaaatttaaggtcagctgagttgagaaatgttttctgtacatgtcttttcgcttcgcaaatacatgtttcgtacccggacgctcatgtttgatgcgttcttcgattctaatgtcttcaagcagcataaagagctgcttggcaaaacttttaaacgtaagatggcgatggatatcattcaaaaagttcgcaaactcatgcagcgagctatatcttgttccgactgaacgcaggtagacgtcgcttttcagacccgcttccatgtcctcagctgccctgtctttccaaaagtggctcatatagattttcttttcaaatggattgtaataggactgaacgccatactccacttctaccgcttcactcttggtgagtgttttggccaaatcagtcagcatcataaataaaaatgaatcaattgtgctgtcgttaaatttgataaatttcatcgcagccccctcattcaaacagagtttccgcaatatttcggacggccgctttttcccgatcatcatcaagcttttctacaattccccgctcaatggcacgacgcggcggaatataagcagctaaatcacatgtatcgattaaagctctgatggatgccgcttcttcagacacctgtccgttattggcctgaacgatcaagtcagaggaaagcgtgataaatctgtcaatcaatttctcgtctttcaaggctgactgagacatgagcacttgtttcagcagctcgcctttaatataaggcacatcaatgatgacaaaacggtttttcaacgcttcattcagaggaacagttccgacatagccttcattgatggctgcaatgaccccgaaaccgcttttagcccgtatgacctcgcctgtaaacggatttgtcatcatttttctgtaatctaatacaccgtttaaaataggcagtgtttccggcttcgccatattgatttcatctatataaagaaaatgtccttccttcattgcctttgtaacaggtcctgaaacaaactcgattgttgcctggccagattgattttcaatcgttttataaccgaccaatgcctcagcgtccaagtcgactgaacagttgacgctgtgcatcggtttatgaaaatagctggacaatgtttctgccaactttgtttttcctgaacctgtaggccctttcagcaggacatttttccccatggctaatgcaataatggcgtcaaataaaatggcttcatcctccgcctcatagcctgatgttcctataagcgattgaaactctggggaaatgggctgctctttatatgataaaagcttttgttgtatatcttccggcaatgttaagtgctgtagttgtgttgtcatagacagattccctttcctattcatattccttaacgagtatactaaaaaagcccctgtatgctcaatacaaaagggcttggatgatattactgcttctcgttatttcccaaaagggctccgcagacaatacgcgcaccggaattgccgcttgggtttgtcagataatcgtccgcttgttcatgaataataaatgcacttccgtcctcgtcgagaatatttagtttacttccttttttcagtgaagtgtcaggcgcattcattatgacatctacctttccatcagcaccgacttcaaggttcggcagatctccggcatgatgccccatcggattattgaagccgtgttctttgttcagtggattaaagggaccgcccgctgattcaaaatccggcctgacacaagaacctttctcataaatatgaaaaccgagagaagcacctggacgcaggctgtttgcggaaatatgaatatcgaggccttcatcatctgattctttgatctctataaagccgactgctttcccttcacgattgaccaactggacatgatgaccaaacgctgacgtttcaaccacttttttttccggcaccctgttaggagggtctggaggttttttttgtccgcatccggcaactcccagtgccgtcagcatcatcaacagcaagagacggtacatactgtctcccccttgttttttctaacagtgtggtcaatcattgtctggtataaacaaaaaagcctataaaaggctttttgtcatactcatttttaaaaataacttcttgcgcccaagtaccgctgtttccaatacgaattgctgagattggaaatgtcgacgcccgatgagcttgcatgaataaaatcaccgccgcctagataaatccccatgtgagacgggccggatttatatgtggtaaagaagacaaagtctcctactgacggctggctgaccttctgcatgacattccaatatcctgccgtactcaatcttgatatagatgatacattattaatgaggtaataaatgaagccgctgcaatcaaaaccggcaggcgtgtttccgccccatcggtaaggcactccaacatattttttcgcttccgttatcattctgtcaatcttcgagcctatttgaatgtttgaccctgagttatcttttggctttgttggctttgtcggatttgaaggattagattttgatgctcccgaaatagtcagaacctgcccgatttgcaacacatccgatgataaattgtttttatcacggatgctttggacagtgactccgagccgatttgcaattttccacagcgaatcgcctgcttttaccttgtacgtcgttgtttttgagggattggagtttgacggctttttggaaccgctgtttccgttcttaggtgagctgcttccttttattttgagcacctgtttaggataaagtgtatctgatgttaagccatttaaggtttttaattcggctacagtcatatttaagctgtttgcgattttccacagtgagtcaccaagcttgaccgtatatgtactttttgaagaacctgaagaattggaaccgctgtttttctttgatccatttgatccgcttgaactgcttgtccctttgatcttaagcttttgccccggacgaatcaggtcactgctcaggctgtttaagcttttaagctcagaaacactcattttatgatttttagcaatcatccatagggaatcaccatatgcaactgtgtatgttgatgttttgcttgaattagatgaggatgtcgtgctttttttgctgctttcaggaaccttaagactttgtccgacataaagcaccgttgatttcaatttgttttcggatttcagagctgatattgtcgtatcatactggcgggaaagtttccaaagagagtcaccgctttttacttttatcgtttttgcttccgcgggtgctgcggccatcgacgacccaacaactgcagaaacagccaagccggctacaatcttctttttcattcattcaacctcctaaactgtttttttgcaaaaacagctagtatttcgtttccaaaaatggcacacaactgttttatcgtcaatttttcagcaagttaaacccttttcaaacatttggcgcagcattttcagcatcgttcgacctttaaaccttcaaataaacatctaacattttacataagcacgatatgtttttcgaaagtctaaggaactatttaagcgagggtaaaaatgatggttttctattgatgaacgaagcagtttctcctcctttcttgtctatttttctaatcaattctctatcggcatgtcaaatcccttcctctgcattcttatgaaatggcaaaaagcctgttctttcgataagaacaggcttttacactatgcatttgctgattgagttttttgttttacagcttcaagaatgctgtcggctgcttttttagagccgcctgccgctttcagtgattgtccaatttcttttgccttttcagcatacgaacgattattcattacttcttgtatcgtctctttcagtaggctttcagacaattcttcctttttaattacttttcctgcgccgactttttctacctgatctgcgacaacaaattggtcgcctcccatcggaatgacaacgagcggggtttcaaaatacaaaccttcacttgtgctgttcattccgccgtgggtcacaaataagctggctcttttcaagatctcaagctgagggacatacgggcgtacaatgaaattctccggaatgtcgtttaactcacttgttttaatatgcttgccgatggaaagcacaactttaccgtcaaagtccttacacacttcaaggcattgattaaaaaactgcttttgattgttaaaaatggttcccattgaaataaacagcacgttttcattgtcaatctgatcaaatgggaaatcattgtttccggctctttctgtaatggaaggaccgacaaatacatatcgctcgccaaattgctcatccagtggctgaaatccccttgatgtaaagatgattgtcaagtcaccatcagctaaaaaaacatcaaatggcttcttgatctctgcttgaaaatcagcatttaaagtttctgcaagctgctggtatgattcataatgaggcgaatcttcaagtgatcctttcatgtacgctcccatcatttccttagcaaattcctcattcatcgcaaaggttgtacacaatgaaaatcttggcagcttcagcatgttggcaatgactttacccgcgagaagatggtgatcatatatgacataatcatacgattcatgtttgacttcctcataaatatgagtcgcgatatccttacaggctttcaaaaaagcgcagagcatttctgtgaaatctctttcttcatcgccggttgcgtttttcccgaagtaatctcctctgaaatcatgatactcacgaaactctatatcaagagctgtgattttttctttatattccttcactgcgtagtacgtaatgttttctccccgggatttcagctccttcatcacaccgatagagggattaatatgcccttcaccggggaaaccgatcattaatacattagccatgcggcagcacccttcctttgaaaatttatgtaatattttatacggtactataaatacataaacaggtaaagtatttcacttaattaatattcattacatataacttttctaccagtttatatttcctgtcttcaagacaaaaagcattcagcttgaagcgaatgctttaataaagatgcgaattcagtcattttgtctcatgataggattcttaatcaggccctttttattatttttacgttcttggtgaaattaacggatataatacaccgtctttggcaaacgacatcttccctgtttcctctgaaaccacgagcaccagtgcatccgtatatcccgacataccgagagccgcccggtgccgggttcccaaatggatatccacttccttcgtcgtcagcgggagcacattggctgctgacacgagtttgttttccctcactaataaagcgccgtcatgaagagggtttccgggaaaaaagatgctttcaattaatgaagagctgatctcggcgtgtagggaggtgcctttttgaataaaatgttcaaccgggtctgctctttcaatcacaattaaagctccatgcttatgttccgataaggctttaatcgccttggccagctcaataaatgccggcgtaaattcctcaatgtatgattgcaaataaaaggaggatgcaatcccctgcatgtcctgaaaaatgtgccctaattcatctaattcacaaagaagacactggtctttttcgtgaagcgttttcaggattagagatgcatcacctaatatttgctctaggtacacctgtattttccccttgaacgcattttctgatatctgctcatagcgcataatcttcatctcctgttcaaatttccaacttttcacgaatgcttatcttattgatgcacattctattggtaaaggagggatgtaaagaatggaaatcgaaagaatcattcagtatatttgcacctttttaggcgtgatttcgctttcttttatttatgcccaaatgtttagaaaaacgaaaccgacaaaaaaagaataggcccggcgttcattgctttttatacataaaatgttataatttctctcgttatgaaaaagaaacggagatcaatgtatgaaagaaactcaaaatgcccgggaaaaaatcaaacagctcttgcacattttaataccgatattcattacccaggcggggctttctctaatgacttttctagatacggtgatgtcagggaaagtcagccccgctgatttagcgggtgtcgcgattggctcaagcctttggacccctgtttacacaggacttgcaggtatattaatggcggtcaccccgattgtcgctcagttattaggtgcagagaaaaaacagaagatcccctttactgttttacaggctgtatacgtggccgcgcttcttagcatcgccgttttagtgattggatatgctgcagttgaccttattcttggccgattgaaccttgatattcacgtgcatcagattgctaaacactttttaggctttttatcactgggaattttccctttatttgtttacaccgtgttgagatcattcatcgactcattaggaaaaacgagagtcaccatgatgattacactcagttctcttccaatcaattttgtattgaattatgtatttatcttcgggaagttcggaatgccggcacttgggggtgtaggcgcggggctggcatccgcgttaacttattggtgtatctgcatcatcagttttttcattattcataaaaacgcaccgttttctgaatacgggatttttcttaccatgtataagttctcttggaaagcatgcaaaaatttgctcaaaatcgggctgcctattgggttcgccgtgttttttgaaacgagcattttcgcagctgtcacgcttctaatgagccattttcatacagtgaccatcgcgtcccaccaggcagccatgaattttgcgtctcttttatatatgctgccgcttagcgtgtccatggctctaacaattgttgtcgggtttgaagctggtgcagcccgttttaaggatgcacgctcatatagcttaatcggcatcatgatggcgatcggcttttctttgttcactgccgcctttatccttttattcagagagcaaattgcgggcatgtacacttctgaccccgatgtgctccggctgacacagcactttttaatttatgcgctattttttcagctttccgatgctgttgccgcaccgatccagggagcactcagagggtacaaagatgtgaactatacgcttgcggccgcttttgtctcttactgggtcattggccttccggtcggttatatggtcggtacgtttacaagcctcggtgcattcggctattggattggattaatagcgggactcgccgccggagcagttgggctgtttttcaggctggcaaaactgcaaaaacgttattcgcaaaaacaacacatttaaaagaggtgatcaatcatggcaaaaaacaaaaaattattcgagtatctttcccagcatgcggaaaccatcagttcaacatggtatgaaacaatcgaggagactgatcccaattccatttatgcctcaacagaccctgttgtcattcacaatttaaagagccagaatcttgcctttaactataaaataaaccgtatttttatagatgatgaggacatatacttgcctatactgaaagaatgggcctttgaagtcacacaggatcaagagcatttaaaaactcctatccactatattattcgggagtttgtcagagtgagagatttatatgtttcttatgtgaaagaatttgtccatctcaatcaggatactgtgaaaagcgaagaagccgaagacctgtatcacgcccttataaaagcgtttgatcttgtgattcatatttttatagaagaaatgtacaaaaacacaagccttcagcttcaggcccaaaaagatatgattactgaattgagcgctccggtcatcgtgctgtttcacagcgtcggactgctgcctttaatcggagatattgatacagtccgcgccaagctgattatggaaaacacactgcatcaatgtgcgaaaaaaaaggtgacacaactgtatattgatttgtcaggagtagctgtgattgatacgatggttgcccatcagctgttcagtctgattgaggcgcttcgtttaatcggtgtttcttcaactttgtctggaatccgtccggaaatcgcgcaaacagcggttcagctaggtttgtctttcgaaggtatttccttgagatccactctcgcttcagcaattgcatcggacttaaaattaaaaaaggtataaggcttaaggccttatacctttttgattaatcattccattgatacgtccaatatatttcttcttcaaaccatgttgccataacaggttcattatttttcaatttctcttcaagctctctgagcatgccttctgtttgtgtgcggtgagctcttaacgcattcattttaatatcagctacttctttgatatcaagcacgacatcagcttcgccgagaacctcttctctgttgcgggtaatggccatgcagattgtacgcggacggtcttctttctttttgcggtacaatgcacggataaccgcttccccgcatgcatcatggtcagggtgcacaccgtgtccgggataaaatgtgacaattaaacttggttttacatcatctatgatctcttccatgatatcagctagatactcatcgtcttcaaattcgagcgttttgtcacggagtccaagcatacgaaggtcattgatatccatttctttgcaggcattgatgagctcttgttttcttaatagcggcaacgtttcacgattcgcgaaaaatggatcgcccatatttctgcccatttcacctaaagtggcgcaggcatacgtaacgggaatgtctttttttctgtttaaggcaatgaggcctgccactccatatgattcatcatcagggtgaggcaggattactagtacatgttctttcattattattcacccttttctttaaactgtgaacggtttttcgctgatttgcagagaaatagccagtttaccgcccggcagatgtcccgccattaataaacggttttcttcatctaccgtgtattcagtcaagccttcagcataaatccagccttcttctgttttcaagccaacgcggtaaggtccgttgcctttgatttttgcctgatgataagtgacttttgcattgcggatatacgcaacaaccgtcatgttcttttcatttaagtgcgctgaataagaacctgtggtggtttctaaatggatatatacagggcggtccgcatatcgttctaaagatgcttgcacatcttcttttatgatcgctttcatgattgctcccctctttcttcttttaaatactctgcacgttctgtatgtaatttgaccagctgatatttcacagccggttcgagctgtgaattcacaatgcgctgaatcgcggcaaaatatttttccagcatcggttttcggagtcttggatgtgttcgtttatccaagagctcaagatcaatcgcctctgctaccgcttctgcgtcatcatgtgcgagagatcggttattccaaagtgaagcataggctttcactatctctttatcattgtccatcgtcttgctcctttatgtcttacatacatgaaatgattatacataatatatgcatcagctgaaaagccaaaggcctcaatggctttttgacgcccgtttccacttcacttgtgaaaacgtaaacaagagcagcgcagcccatatacagctgaatgtaaaagccttcgagcttgaaaatggctcatggtaaacaaacagcccgatcagcagggtaatggtcggcgcaatatattgtaagataccgacttgatacagtggtagccgtttcgctccttccgcaaacaataagagcggcaaagccgtaaacacaccggccaaaaagagaagcagccacgtccctccgctttctgcacccgctggctgatcatgtccactgaacagcaaataccccaatgcaatgggcataatcatgaatgtttccagcgttaatccgatggcgctcggcaggcttgttctttttttgcttaacccgtacagcccaaagctgaatgcaagcagaagcgcaacataaggaatggagccgtattggaacgccgagatgatgacaccggctgccgcaatcgaaacggccactaattgcaggcgattcagcttttcctttaaaaataaaatcccaaggagcactgatacaagcggattaatgtaatagccaagactagcctcaagcaaaaagccatggttgacagcccatatgtatacaaaccagttgatcgaaatcaggatagaagcaagaaataaagagaggatccctccgttctttttcagagagcgcagctcctgccatcctattttccattgccgcaagaaaaaaagtacgatacacataaaaacaaaagaccatataatacgatgagccaaaatatcaagagccggcagctgttcgagaagcttccaatagagtggaaacaggccccacatgataaaggaaacggctgtgtaaataacgcctttttttgtttctgaatattgcatttatatccctgcctttctttagagcatcttatattatatcacgtgaaagatctggcgggcatatactattttgtccgtgaagaaaggatgtgaagacaatgtttgagtggaacaagtactttcctttccacaatcaattttctaaagaagcattaaaaaaagctgatccgaaagaagttgaaacgtatgtcaatcgtgtgatggaaagtgtgttcggcagtgattatgcggctcaatttcctttccgcgatcctctcccccaaaaagaacagcccgccaaacctgatgcaaaacctgatgtcaaacctgatattgatatattcgaaactgcagaccatgtgtttgtaaaggtgccaatcagcgaagaatggctggaacaagtgagaatcaaacacacatctcacgaattatggttggaaaacttcccaagagcagatcatccgaaaaaagtaaaccttccttgtttagtcaaacgcaaaggaacaaaagccgtctataaggatggccttctggaagtcatgtttcaaaagcagcaagactacaatatgtccgaggtagaaatcatccgataaaaaacggcctgcaatcgatgcaggccgtttttattaatagaagccgggatatcccccgtatggcacgccggcaccaaaaccgtacggtccgcctccatatccataagggccaggaggataggcatagggacgagaatagttaaacagcgcactcccgagaaaaccgcctaataaaccgccgactagaggagcgccaaacaaaaaaggactacgcgccggatatccggctggacctgggattccgcgtaaatacgaatgatgagggtacatgattttttcctcctttatgtctgcctatacgtaaagtattcagcaaggaagaaaaacgattgggctacggactgtctatgattgttacatcacaagccctgccaataacacacagccgagtcctgtaaccgaaagaactgttgtaagcaacgtccaggtttgaaatgtttctttcatgctcaagccgaaaaattcctttaccatccaaaatcctgcatcatttacatgacacgcaatgacactgccggctcctgttgcaagcaccattaacgcagggtttacactgccagcctccataagcggagctgccattcccgctgtggtaagcgcagccacggtagcagagcctagacacagacgcagaaccgcggcgatggtccatgcaacgaatagcggcgacatgtttgtttgacggaaaaaatcagcgacataatcgccgactccgccggcaatcagcacctgtttaaacgctcctccccctcctatgatgagcagcatcatcgcaatttgcgaaattgattctgaaatagatctgctgatttcctgcatagatattttacgggcatatcccatcgtatagagtgcaagcaacagcgaaatgagcattgccgttcccggagtgccgataaattctataatgtcttttccttttgaatgttcactcaataataaagaaaaaattgttgccattgccataaagataaccgggaataaagacgtgacagcactgatcgcaaagcccggtgtttcatccagctgaaattctttccttggtcctaaccccgataggtttccatgcttttgatacgcaccaggaaaccgtttcatcgcaaatttattaaataatggcccggcaatcacagttgtcggaacagcgatgatgattccaaaaagcagcacctggccaatatgggcaccgtatgcaactgagatagcagttggagcaggatgcgggggcaaaaatccgtgagtaacatttaaggcggcggccatcgggattcccagatacagaaaaggcatttttaattctttagcaatcgcgtaaacaatcggtatcaacagaacaagacccacttcaaaaaacagcgcaataccgatgataaaagaggcaactacaaccgccgcctgtattcgtttcctcccgaatttgtcaatcagcgtaatggcgatccgatagccgcccccagcatctgagacaagcctcccaagcatcgcgccaagtccaaacactaaagctaaatgccccagctgcccgccaattccagcctcaattgaaagaacaattttattgatatccattccaagtccgatggcaactaaaaatgaaacgacaatcagtgagacaaaggtatttaattttactttaataatgagaaataacagaatcagcactccgacagctacaattaaaatcggcatggtacccctccaaaagtgttttatatgattctcgcgacaatgttttggcgcttttcatgcctagatgaacagaaagcgctttcattaataactaaaaacgtcttggttatatgattgttatcttttgatcaactaatatgttcatactaatctcctaatcaatgactgtcaatcgtttttatgagcttgtctcgattacctaccacctaactcaatgatttattagttatatgttgattaacttttggttatatgttatgttttttaaagttgactgccaatcattatatctctccattgtctggaagcaaatgagacaatatgagaacagacggataacaacttcacaagaggaggagtacacatgccattattgcgttttgatgtaattgaaggccgtgacgaaaaatcgctgcaattgttattagatactgctcaccaagcgatggttgaagcgtttggtgttccggaaagagaccgttatcaaattgtccatcagcatcccgcaaacgagcttataatccaggatacgggattagggtttcagagaaccaaggatctggtcatcattagcatgacaagcaaagcaagaaccgaaagccaaaaggaaaaattgtatgctctgcttgctgaaaggttagaagaaaaatgcggaatttcccctgaagacctcatggtatctattactgagaatggtgacgcagactggagtttcggtctcggtgaggcgcaatttttgaatggaaaactataagatttcgtctccccataaaaaaaagagagagctccaaagaagctctctctttttttcataaatgcggaagtcatcagtatagaagcatccagcaatacgaaaaacctggatctccttttagattcggtttaaatgccaattggaagctgactttggccgaaaatataaaattttgctgatttgcataataagataactcataatccccatttacaacaggttggatgctataacttattgatcatttccatgaacatgacacttttgccaatccggaaatgtcagtctgacaaatataaaaagtcatgtaaacgggtgtgaaccgtacttacatgactcaccatggaaacaaaggctctttttcaggtgccgctttccttatttctcttcttcacacactgtgtcaccaggctcgcaaaattgatcggcccatgcctgcatttcttgaaatacagcttgaagcgctgttcctttttcagttagcgtgtagatgactttgaccggcgtttcagggagaacctgccgttcgacaatctcgttttgttcaagctccttcaagcgctctgccaacattttttggctgatcatcggtattgtttccgttatctctttaaaccgtttcggcccatccattagcacatggatgatcagaccgttccatcgttttcccagcaatgagaatgcggattccattttagggcacatcgtatttcccacaagtcttcatcccttcatctattgattgacatgtattcaatgatccattacaataatctttcaagttacatttagtaagcttctaacttttctattatcataccacgtttatccgaaggaggaaacactatgacgaatactctggatgttttaaaagcacgtgcatctgtaaaggaatatgatacaaatgccccgatctctaaggaggagctgactgagctattagaccttgccgctaaagcgccttctgcttggaaccttcagcattggcattttacagtattccacagcgatgaatcaaaagcggagcttcttcctgtagcgtataatcaaaaacaaatcgttgagtcttctgctgttgttgccattttaggcgatttaaaggcaaatgaaaacggtgaagaagtttatgctgaattagcaagccaaggctatattacggatgaaatcaaacaaacattgctcggccaaatcaacggtgcttaccaaagcgagcaattcgcacgtgattccgctttcttaaatgcttctttagctgctatgcagcttatgattgccgcaaaagcaaaaggttatgacacttgcgcaattggcggatttaacaaagagcagttccaaaagcaatttgatatcagtgagcgctatgttccggttatgcttatttcaatcggcaaagcagtgaagcctgcccatcaaagcaaccgcctgccactttcaaaagtatcaacttggctgtaaggatatgaaaaaccttagtccgaaatccggactaaggtttttttatacaatcgcctctttgtaccattcacgagcttgttcagcttcatgctgagtcagctgatggcccccgtcctgccagtaaacggaggctgatgccccgctgtcacgtaaatagcggtaaagctcttctgattcttccttcgtgcagagagggtcgtatttcccggcaccgataaaaacagggagccccgccatatcaggcagctcgatacctcgaatcggaaccattgggtgatgcagaatagccccttttaacacatctttataatgaaaaagcaggcttgccgcaatgtttgcgccgtttgaataaccgactgcaatcactcggccgcgattaaactgatgcgtttctgcagcctcgtcgataaaatctttcaattctcttgtccgcaccacaagatccttttcatcaaaaactccttcactcagacgtttgaaaaatcgcggcattccattttcaagcaccgatcctctgacaccaagcaaatgggcatcagggtctataaaccgccccaatgaaagcagatcgtgttcattaccgcccgtgccatgcaacagcaaaagtacgttgtcagatgttcctttttcataaatatgcttcattataaattccccctattaaagttcaggtaaaatgtctgtaatttgttgtctatgtttctccagccattcaggcagttttaaggaagtccctagctcagcaaacgtttcatctgtcataaagcctggttcatctgtggcaatttcaaataagataccgcctttctccctgaaataaactgatgtaaagtattccctgtcgagaatttctgacgaaggcagatggttttcagcaataatcggcagccatttcgcctgttcgtttttctttgtccgaaacgctacatggtgtaccgtaccataccctccgactcctcttttttcaggatgtaaatggacatcaatgacaccgccgacggccgctgaggatgccagtctgacaatctggtcttcttcggccactttggtgtatccaaagctttccgttaacaattgtatggtcgcctgcgggtcgtaggaatatagcagcacacctttcattcccgtaattgcttcatttgttgtgatcccgtcaggcgtccactcgcttttgccgcttttcgcatcctccatgatcgccagcggaaggtcttctgtatcatcaaaaataagacctttttcaccaaacaacgttttttcctctaggctcagcccgcttttctcaagacgctccttccaaaaaaacagggagcctgagggaactgaaaagtacacccggcccgcttggccttttcctaccgttccctgtccgcttccttggaacggaaaaaaggtcattattgtaccgggatctccgttttgattcccaaagtaaaaatgatacgttccgggatcatcaaagtttactgtttttttaacaagcctgagcccaagcacttctgtataaaatcgcaagttttcttgcggatctctggcgaatgctgtgacatggtgcaatccttctgttttcattttctcactcctatttatctcgatttcaagatatttattattttaaacctttattgaaaaggatgcaaaccatgtgttttgattaaataattgaaaaaatcatttttttctaataattatcttgtgatcttttcttacaactgctattatagtgagcattatcatgtttcaggaggaaagtaaatggttaaaaaagcacttattgttattctcattcttttgccattcgttcagctcgcgcttttgccgcttgtgaatcgaatagaaccgattatgttcggcctgccgtttttccacttttggctgctgctgtggattattgttacgccgttatgctcgtttggcatttatcagatgcaaaaaaaagatggaggacttgaataatgcaagggaatctgactgcacttctcattactgctattattgttttaaccgttgtctgtatcggctttcttgccggaagagacaaatcctcacgcacttctgtggaagaatggtctgtcggcggcagacgcttcggcggtcttctcgtctggtttttagtaggcgctgacctttatacggcctatactttcttagggttgaccagtactgcttttacaggcggaagtgttgcatttttcgccattccttattctgtgttggcctactttatcgcctacttcttcttgccaaaactttggaaagttgcgaaaattcataaattaacaacactcgcggattatgcccgggaacgttttaacagtaagcttttggcaagcctcgttgccatcgtcggggtactcatgcttattccgtacatatgccttcagctgagtggcattcaagacacgcttcaggttgccggcaccggatatattaaagaagcaacggttatcggattattagccggcctagcggtaacgtttattgtgtatatcactcaatccgcacatggcatttatgaaggattctggggattggccgccaacatgatcgctgtggttatcctgaatccgctgttcgttaaaaacgcgggatccaatcctgtcattgaaggtttatttggcaaaaaacaagacgctaatccaaatcaaaagggtgcataaaaaaaccatacgcggcagccgcgtatggttttttttacatttcttttttcagtgtttcaattgccttttccatttgcgtatcattatcagacagcttcttttgaagttctatcattaatttcgttgttgtatcgccagtcagtatgcctgtttcattcagcttctcttttttctggaactgtttgacgacagatacaaaatcctggtcatacgtactgttaacctttaccttgtaaccaagtgctttgagcattttctgagccactttgacgtttgtgcctgtatcacctgatttgtacgttttatctgcgtccaaatacggcagcttcgcgtaatcaggcagctctgctttcacttgaggcttgatgccttttttgtgaatccattcgccgtcagcagtcagccatttggcaactgtcagtttgacggtagagccatcatcatattcttttgccgtttgtactgtacctttgccgaatgtcgtctcgccgattaacggtacgtctgacgattcatgaagggcagcggccataatctcggctgcgcttgctgtaccgtcatttactaaaacgacggtcggcttggtcactttccgttctttttcggccttcatgacttcttttgaaccgtttttgtattcaacctgcatgatgtttttccctttatcaatgaacaggttgctcatcgtaatcgcctgttccattaagccgcccgggttgcctctcaaatctaaaatatagcctttggcgccttttttctctaaactgtcaatcgcatctgtcagctctttagctgttgtttcagagaaagaagtgatttgaatttctccgatgttgttgtctttcatctctgaatagacagtctctacaggaatggtatcgcgcttaatggaaagatcgatattccccactcccgctctgttcagttcaagcttcacctttgtgccctttttgcctcggattaaagcgacggcttcatttacattcatgccttttacgctttttccattcaccttaatgatttggtctctcggtttgataccggctttttcagcaggtgaacctttaattggggatacaataaggatttctccgtctttctcctctacttgggctccgattccttcaaaagatgctgaaatcgtctcgtcgaatgatttcgcttgctcttgatccatatatgtagagtacggatcatccagtgattgaatcattcctttaattgctccgtctactaatttgtcatcatctgttttttggtaataatcacttttgatttgctcatacgctttatttaatttgtcgaacttactgtctcctgtgcttgctgatttttggcccaggatactggaattgcccgtaataaataaagtaagcgccgaagcgacaactgcagtgatcagcacaataaaaaacagttttaattgccgtttcaattaaacaccacctttttcttcttacattattatcatggacgaattcttattcgtcaactcggagcagaaatgaaagagaaacgcccttcttttgcttttcataaacctatgtctttatacgacatatgataaggaaaaaggaggattcgatattgagccgatatttagaaatgctgtccttattcggtgtcgcaggggcgcacccaggcgggctggctttttcaaaagcggtcttgcaaaaggctgcgccctccccggatcagccgattcttgatgccggatgcggaacagggcaaacggcggcttatttaggacatttgctgtatcctgtaacagtcgttgataaagatcctattatgcttgagaaagcgaaaaaaagatttgcgaatgaagggcttgccatccctgcatatcaggcggagctggaacatctcccgttttcttctgagtccttttcctgcgtcctgtcagaatcggtcctcagtttttcacgcctgacatcctctcttcaagaaatttcaagagttttaaaacccggcgggatgctgattggtatcgaagctgctttaaaaaaaccgatgccccctgcagaaaagaagcaaatgatggatttttacggatttacttgcttacatgaagaaagcgaatggcataaactcctaagatcctatggctttcaaaaaacagaagcgatgacacttcttccggaagacatggaatttgaaccaaccacagaaatggatttatcgcaaacgattgatcccatctattacgatacgcttcaaacacattatcagctcatgcagttatatagtgagtacatgggtcattgtatttttatcgcgtacaagtaaaacggcgtatcgccccctgttttcgtccaacctttttttcctatctatcatatgctgatagaaagtcaggataggaggggaacaatattggagagatattatcatctttgcaaaaaccatcaaggtaaagtcgtcagaattacagagagaggcgggagagttcacgtcggcagaattacccgtgtaacaagagacagagtttttatagctccgaccggcggagggccaagaggtttcggttacggatattggggcggttattggggatacggagcagcttacggtatttccctcggtttaattacaggggtcgctcttgctggtttattcttctggtaagcatagaacaaatgctagattcaccagacacaatgaagcccgcttatctagtgtaagcgggcttttcattttaaattttcttcactttttcaaagtactcttcaagcgttaaatcattatcttggatgacctttgcggcttttttgcctacatagcgcagatgccatggctcatattcatatttcgtgatatcttctttatttttcggatagcgaatgataaagccatatttataagcattgtcctgcacccatttcccgtctgccgtgcttccgaacgcttcatttagctcaaagccattgctccggctcgaaatgtccatcgcgaggcctgtttggtgctcgctttcacccgggtaagcaaccgcttcctttgccttcttttccccttttaggcttacttcattgtcaaaaatgactttctgtctgtcatacgaacggtaccctgagacagctgccagttcatagccttcctttttggcagcatcgaacattgtttttaatgcgtcggccgcttcttttctgatgtaacgtttttgaatcttttcttcaaaagaaaactctacatctggtatgacaagatcgctaggttcatagtttccgggcagtgcatattgtttattgacaagcgcgagtatattttctggattttgaatggtttccagaccatcgacttttttaatatcattgaaatactggctttccaaggaaaactcactgttttgagtgtttgattttttgctgtcagctgttttttgttctgtttgctttgtttctgctgtggttttcgtatccttttgagcatctccgttcgacatgctgcagccggctccgactattgccgttacactcagagcggcagccagtgagaaccatttacctgactttttcatattacattaccttccttttatcaatcgtttccgcattcataaagaagaggctgccggcacccagcacgcctcttgatatattttattgtgatacggaatgtaaagccacttctatcatatcatgaaatgtcgtttgacgctcttccgctgtcgtttcttctcctgttaatacgtgatcactcacggtgagaattgacagggcttttcttccgtgcttcgctgctaatgtatacaatgcagttgtttccatttcaacgccaagcacaccgtattttgcaagtttttcaatttgtgaatcgtcgttgtagaactggtcagctgtaaatacgcttcctacagtcaccggcacacctttatcctttgaggcatcataggcattttttaaaagctcgaaatctgcgcaaggcgcaaaatcaatgcttccaaaagcgactctgttcatttgtgaatcagttgaggaggtcatcgccaaaatgacgtctcgcactttgacatctttacgaatagcgccgcaagaaccgactcttattagattttgcacatcgtagctttgaattaattcattcacataaattgaaatagacggaacacccattcccgtgccttgtactgagatttttttacctttatatgtacccgtaaatccatacatgcctctgacttcattgtagcattctacattttcaagatacgtttctgcaataaattttgctctgagaggatctcccggcaaaagcactgtatccgcaatttgtcctttttcagcacctatatgtacactcatctcatatcctcctgtaaatcaaaattatcatccagcccgtccattttacaacgaatgtcatgatgaaacaaacttcagcattgattataaaggaatatgtcgaaaaaagaaatgttcgaggatctgttaggcacttcctcagaaaaacggataatcggggtgttaatttgaaaacctaaccgcaggaaggaggggtgggacatgggtaaaaaacatcgtaaccggatcaccggccaaaaaaagaacaatcatatacctgaaaaagatatcattgcagctgaagaagcacacgggaaagaatattctgctgccaaacgcaagccttaaaactgcagaaaactgcgggtttccgcagttttcttttcattatgtcgtttgtacaatcagacgattgattttcctccagccggcgggaagcagttgataatatgttttcccttttctgccttcatcaatcaggatcacgtcccctgtggccatgaatcttgcatcataatcactcggaacagtgtcgaatacattaaacaaagagaatgctcttttcagcacgtcttgatgatcgctcccgttcagttcagttcgatagacggctctgtagccctttttttcgccaaaccggggtgtctgaaatattgtcacgtcataggaacaagacttctttttaaacacggataacatcatcaagatcccctcccttttatttctttaacatattggcgtttttgctgtgttttcctctctctatttttgtcgaaaccgcttaatcttttcgtcaaaaccttttactaggaaaaacagaagcaagccgaggctaaagcctcctaacacgtctgtcacaaaatgaacccccagatacactctgcttatgccgactaaaacagcaattacaccggctatgatatataccatttttttatgcttggacaaaaacgggaggtgtttcactaaaaagtaagcaataacaggatagacacaagcagcattcatggaatggccgctcggaaaactgaaggatgattcatgaaccagcggtgcaaaatcaggcctcactctttcgatccattcttttaagactttgtttaacagccgatctgtgccgaatatcaagagcatcaacaggccgtcccatgtttttctgtagaaaaacaggcctgctccaatgatgacaattagagggagcagaaaagaagaagcaccaagatgcgtgatccccgtcatgacttcattaagccatggctgacggatcaaaacagctgccttgcttattgcttcatctgcagattgaacagcatttgtatgaatggccgcagctagaatgagaaagaaaagaaacaaactaacgggcttgtacaattttaaccacctcaattttcacagaagtcatagaacatgaataataaaaccggagctgaccgctccggttttaagcctcactcatcttcatccagctcttcatctatcatacatttttctatcaaataatcaaaggtaatatcagcgatttcaaacagctcatcctcactcggtatgtagccccgtcttgcaagctctctgtaaaaaaattcagcgatttcttccgtatcaatcacaagatctatttctttcatctccgtaccgcctccttttttatgttttatgaaaaaacaggctgaattatacccggtgttctaaacaattctttcagtcatatattgaataaaaaacgagccatgggaggctgacgctatgattgctaaaatgatggaagcactggacggagaaagatttgatatcataatggaaaaaacgctcaaaggaatgacgcgtgtgatgatttggggctgtctgccatattttttatatgtcttgatccgtatgttcacaaactaactgaaatgctcttttaaactttccaaaacaaacatcatcatgtctttatattcttcatcatgaaacatttcgtacagaattttgtagtcattataaatatccagaagctcatcaacaattgacacagcaaggatgtgaagggtatcttgatcttcatcatcgccttcaaactgaagaagagcagacgatgcgatatcttcgccgatctcatggccagtttctccgacataatggacaaacaacagctgatgcacaaactggtccatttcatattttctaagcaccagcgtgagatcctcttcctccgtttcaagccactctccatcctttaaacgggtcagctcataaatgatatcttcccagccatcttctaaatatctccaaatttctgttctatggccgataatgcgaaagagttcttttccataatcttttacataaacaacgtccccaataaggaattcatattcaatatcaagcttctccatgtcgacaatgacaccctcataatctttataaagctgaatagatgattcaaagtataaaacttcgttatgattgacttcataaagatagtgtttatcaatttggtgtacttttgtgatggtgccgactgttccatacataatgacgactacgatatcccctacttggaatttcggtttgttttgcttcatggtgtctcccctcgccgcaacatttctcatacgctatcgtatgccgggtgaagccaattcgcatgggcatgaaaaccaaaggaaatatccaattatggtatgggtatggacataaaaaaatccgcagtgatctgcggatgaaacagctattatctgccgtgcacttcagactcgtattgatcccaagcttcatcaaacgtcgccatcgtgtgaaggtaatcagcattcagctccaaatatgaactgatttcatgataatcggttgatgtttttggaaagctgtgatcctcatacgcctgattggcaaattcactgatgctgtccttcggcttagggtgtctgtatttcaataaatagtgataaaaggatttcatgggtttcccctcctggtgtctgtcttttgttgttctattatacagttcaagtgtaaaattacaacaaaagaatactgaaacatgactcaggagaagtcaaaatagttgcgtttcaaaattctttctgtctccatgatctgctgatatgtcaggctttcaagcagtttttttgtttgaattaaaagaagctgatcctcaatctccttaaccgtgttttcctcttgataggtcataccgcaggaagaacataccatggcaggagtgtctgtcagttctatagccctcgttccatcaggaagctcccagtacaccgtgttcctgccgggcactgcttcaagctcgccgcaccattcgcatgttttcatgaagaatcccctccgcattcagtctctttctgctttttctgctgcgccaaaaatttcttttctttgagctgatctcttttctcacgacggtcttttaatgtttcatgctccggatttgcgatgtatgcctctctccttttgattctgtctacattttcaggtgtaaacgaaacttctttgtcagcaaaaatggcactcagcccgatcggctcctttttgtcagcggtttcaggaaaaacggactcaaaataggcgtctgcctgattggggatataattctctggttccggatatgacgtaatcacaccttcaaaatttcttaagatcactttgtcaggactttgtgacaggacatagtttggctgcagggcgattttacctcctccgcctggtgcgtcaacgacaaaggtaggaaccgcatagcctgaggtatgacctctcagcccttcaatgatctccaaacctttggaaacaggagctctgaaatgcccgattccctctgacagatcacattggtaaatataataaggacggactctgatttttaccaagtcatgcatgagctttttcataattggaaccgaatcattaatacctgctaatacgacagcctgatttccgaccggcactcccgcgttcaccagcttttcacatgcctcaacggattcttctgtcatttcgatgcttgtgttaaaatgggtattcagccagaccggatgatattttttcaatatctcgcacagatgatcggtaatgcgctgcggaaagacaacgggcgctcttgttccgattctgatgacttccagatgcggaatgctgcgcagctcttttaaaatatattctaaaatttggtcgttgatgagcagcccatcaccgcctgaaattaaacaatcgcggatttcgggtgtttcccggatataagcaattgcagcatcaagctgttttttggggacgcccattccgatttgtccggaaaagcgccttcttgtgcagtagcggcagtacatggaacattgattcgtgacaagaaacagcacacggtcgggatagcggtgtgtcagaccgggtaccggtgaatcttcatcctcatgaagcgggtcttccagatcgtattttgttttgtgcatttcttcagaaagcggcacagactgcatgcgtaccgggcatctcggattgtcggggtccattaaagaagcatagtaaggtgtaatatttaaggggatcgttttggtagaaattctgacgccttcctcttcatcctcggtcagattgatgactttctttaaatcatctaacgttcttacagtgtgtgtcagctgccaaagccaatcgttccatttctcttccggaacgtccttccataactcgatctccttccaatgccgtttcggtttataccatttgtttttcaaacgaactcctcctcgcgcatattttgacttacagttgcttgcaccaaatattcatgttttcaaggccttcggctataaagcaattattgatcagccttccgccatactgataacctgaatggtacaacacagcattcatcccaaaagacgaagcacgggcgagagaaaatacatgaaagatatcctttccagccatttctttttctaacgcctcgattaaaaagcttgttaacgaatggccgcgatattccggcagcacagcgcaatcggttatttctgcatgcccaagctctggattgatttctgcgcttgctgcgctgatcaggcggtcatgatcaagcatgatataatacaccgtatttgcattcatcgtcttttcaatataagcggggtcaaataccggtgttgggtacgtgcggaatacttttttatacagcatcgatagctggtacatgtcgtttgtttctgcttttctcatcgtaaaaacgggtgtactgtcgttgcgaagacggggcgctgtgcgatatatggcttcgatgatctcctgttcctctgtataagaatctgtttgtctccggctttctgaaaggtaacgtaccatgacacaagccgaatagccgagataatagccctttagatagccctccggcgcaaataattgtttggcaaggatcggctcatcatgctgcttcgcatagacgatgattttttctgcattctcttcttttgccgctgccacgatatccggcagggccttctcaatagctccgtcataacggaccactctgattcgtttattaaagccgtcatggtccaaaactgctgtgacaccgctactctttattgacttgagcatccgcatcctccccatctgtatgaagcccgcaccaatccatgacaaaaagtgcaataattttagcagattctatcatggcttcaacctcaatgtattcattggcctgatgagccgtttttgtttcccccggcccgaaaacgatcactggtgtatctcctgcatggtacaaaagccctccatccgttccccacggggaagcctcaataatcggctctgtctgtttcattttttgataggctgattgcagcacagaaattaaagggtgatcatcaggtaaatcattcggcagccattgagcgccaaaccattcgacttgtacgggatggcgtttaaaccattcgtcatagtattctaaatccttcagccagttttccaattcaagttttacagcttctggtttctcatggggagcaattccgcatctcccttctatgacgacacggtctgcaactgaagatggccaggcaccgcccgagatggtgccgatattcaccggtaccggtattgggatattgtcatacagcggatctgaaattctcgcattgcggactttctccagctcttgtatcgctgtgataacgtgcatgcttttttcaatcgcgcttaccccttcgtagcgtgtgcccccatgtgcggataatcccttcacagtgatccgaaaccacatcgaaccctgctgcttaataaatagtttcatatttgtcggttcaggaatcagcgccccgtcagcacgatagcctctcatgatggcggacagtgtaccggcgccgccgcactcttcatctacaacactctgaaacaatacatctcccttcagtttgacatcgcaggcgtgcagggcttctaaagcaaaaagaagggctgtattgcctcccttcatatccgttgagccgcggccgtatattttaccgttttcttcgacagcttgatacggttcatacttccaatcctttacgcttccttcaggcacaacatcgatatgaccgttcaaaatcagggacctgcctccgccggctcccgtttttttagccacgatattcgggctctcatgaaaatcggatcggttagatttaaagtagggatgctgttttaattgctttatgcttggctcccatacatcaatgtccatctgaaattgccgcagcttttcaagcacaacagcttgggcgttaaactctgaccccaatgtgcttttttccccaatcagccttttgagaagacgaatggctttggccgaatgctgaccaagccacccgattacttttctttcaatgtcttgcatcctcattccccctcttaagaaaaagacatatctattttgatttcagcttctgtcagcctcgtcacctcatcgattgtcgagccattcatcagctcttttaaaatgaagtgatggctatcgacctcaagaaccgctttttcggtaataatcaaatctacacagcctgcagcagttaatggcagcgtacatctttctgttaatttaggccttcccttttgatctgtatgactcatgacgacaaccacttttttcgctttttgggcaagctccatcgccccgcccataccaggcaccttttttcccggaacaagccaatttgccaaatctcctgattggctcacctgcagggcgcctaaaatcgtaatatcaattttgccttttctgatcatcgcaaaagacatggttgtatcaaaataagacgccccttttacagcgcggacaggatagcccgcggcgttgcataaatgcgcatcctcttctcccttttcgggactttctccaatgccaaggacaccgttttccgcttgaaacatgacctgcatgtcaggcggcaaaaagttcggtaccaaggatgggataccgataccgagattcacaatcatgccctgcttaatttcagtagcagcccgttttgcaatctgttctctttctgctactcccaagcccatttccacttcactccctcgcttcgtacaactccctcaacaaaaacccccggtgtgacaatcatttcttcagaaatctcacccatcggaacgatacgctcagcttcggcaaaggttctcctggcggccattgccataagcggattcatattgcgcgcggttttgtcatacgttagattgccgaattcatctgcaatgtaagcattgatgaaagcaaaatcagccgtcagcgcctcttcaatcaagtatcgttttcccgccactgttacgatgtcctttttttcgcaaaccatttgattatcaatgcccacatcggttaaaataccgccaagccccgctccgccggcgcgaatccgttccgcaagcgttccctgaggtgaaaattgaacctctaacgtcccctctgtcatctgttttccggctacaggattggaaccgatatgcgaggcgatcagggttttgacccgttgattaacaataagcgggccgatcccgatatccgggaaaccggcgtcattgcaaatcacagttaaatccgttacaccgctgtccaatatcgcttcaatcaatgaaggaggcgacccgactcccccaaaaccgccaaacatcagaaccgatccatcccgaacatctgcaattgctgtgtcaatgctgattgctttttgaaatggcgccatttaatgtcaatccttttttaagtttttttcgaccgctgcaactgtttctgaaaaaatagagataagctcttccacttcaccgtctgaaatagtaaaaggaggagcaataatgacagcatctccttctccactgtctattccagctttggaaggataaacaatcagcccgcattttttcgcctcgctgacaataagctgggttaccgcctgctcttgcggaaacactttcttcgttttttggtctgccacaaattcaacgcctaatagcagtccttttccgcgcacatcacctataatgccgctttgagatgccgcctcatcaagctttttcttcagcacagcgccctttttttctgattgtttgatcaagccgtgctttaacacatatcgcaaaacttcaagagcagctttggctgaatagggatgtgcactatatgtgtgaccgctcataatcacacctgacccttgttttatcgtttcaataatagaatcagatacgacggcagcagcaataggcgcataccccgcaccgagtcccttccccagtacagcaatatcaggtacggtgtcccaatgctctgtcgcgagcatccttcctgttctcccaagccccgtcatcacttcatctgcaataaaaagcacatcgtgtgtgcggcatacctcacttaatctctcataatatcccggaggcggagtaatcgctgctcctgcagcaccaataataggctcagccacaaagccggcgatgaattggcttccgattcttttgatcatagtgtccagttcatcagctgcagtctgaacaaagtcttcttctgtctcgtgattcagccgataaatatgtggagctgagatagctggataccgctcaatgagatgggtgaaccggtatctcctttcataaaaaccagacaatgaaagcgctcccaaagttattccgtggtaactgctccatcgagacaaaaagatggatttttgtgtttgctttttttcctgccaatactgaatggcgattttcatagctgtttctatcgcttctgatccgctgttgacaaaaaaagaccaattcacatctccgggcagctcctgtgccaagagagcggctaattgctcggcgggctcactcgtaaactgtgagcggtaagcaaaagacacctgatcaagctgttctttcagcttctcagtcacatcacgaactccgtggccgatattacatgtcaccgcacctgacgagccgtcgagatatttttttccggtctgatcataaacatatgaacccttcgcataactgacaaccggataggccgagctaagttctggcttaatcaaataactgctcatgctcccacctcaaaaccccttttaccatattgtatgagtgtccaaatggcggcatgacgttccccgcaaaaactttttcacataaaaagagccttcctaatagggaaggctcttttggaatttcagcatctagcaaataaaagcggctccaacaataattaataaaatgaacaagacaacaattaacacaaatgtatttgtcccgcagccaaatccgtaaccgtacccagagtatccatacatgctgttttcatcctttcttatcacgatatacggcattttatgcgggccaagtcccaaatggtttgtgcaaacgcctatttcatgtaaggaaataatgaaatacagtatgcacccgctcatattttttaaacgtcagcttttcgtaaaactgagttgcaccgtcagtgcttgcagcaactaagtaggctgcttccattcctagtgatttggcgatggacagcatttctttcactaagatactgccgtagcccttcctttgaaactgatctaaaattgccacttcttcgattttagccgttttctcttgatgatcgataaacagctcgccgcacccaatgggaactttctgtgcctggtcgctgtaacaaacaacaagaatgattatacctgcttcatagaaaggatattttctttttaatttttgttcagcgattgcttctccaatataaatggaatcgtaaattttcataatagaagatccgtcgctaagacttttcgccgtcccccatgcggttaaaggatgtcccatctgccccttccagtcactaagcttcatgtcatatagtagctcatcctcgacgacaaaaccgctttttacaagcgactgcttcaagccgagcggaaaaacatgctgcggcgacgcttttaaatggagataattcgcatcaagcagctttggtacggagggtaaaaagttaagtaaccgctccaatggaaacgtatcatgaagctgaacaaagttatgagaaaaaatttgtggaagctgcggatctctgtatacgctgtaatgatcaaacgatgccgattcagacgttaacaatatatattgatgttccgtttttgaataatgtcctgtcatgaacgtctcctttttatgacctatacctttactctgttgcaatattcaatttctttataatctcatcgtacaccggataaaacggctttccaattggaaattgctgaatatttcggaaagaagcggagattggcttctgatgtaaaaaaaacttccttgctacttgttcactaatcgggtgaaagacgccgtttagaaacaaaaacggctcgcgttcgatgaaaaacacccgtcggccaggcggatttatgatcaattcagatcgtttccacgtaatcggcggtccttccggaagcatctccatctcttcttttccaattgtcactatgtcttttctttgaaattgataaaattgaaacgcatactggtccacaattcgccttttttttccggcttcgatataaaatattgcaggatggtcagcttcctttactaaaatataattcggaatgtttaaaattttgccaatcctatattggaataaatatgggtctggaacagcgacagtccgatttagatacaaaaaaccccacttttctccaacaggatgccttacaccctgatcaaaaaaatacacattttgatctgaaccttttacaaaagagccgtcaatcaaatcggcgggcagaaaccgatatgcattttgaaatgaatctggggttttataggttgtgtctaatacttcatttatcggcagaaatggggtaaagttgttgagtctcgcccaaaaaattgcgtcgccatgattccaatgcttcatatcatcatcccagtagcctccaaatttatggtggatgagattaagtaacgaacggcgatgcataacggagcaatgatcaacttgaaaagcggcctgatcaagcactgcattggcatttctgtagaaatgtgagatttcctctcccctttcgtttacatgtactactttttgttttgaatagaccgcctgcgcttcaggcttatgtgaaaactcttgcaccatacggctcagccgctcaggatgataaacagtgtcgtcagtaagataggaaatgtaatcgccgtctgcaaatgggagcgcactgttaattaatgtggcataacgggctgtttttaatcgatctgcaggatacacgaaactgttatgatattgaatgcgccggtcatagagatacttgtgaatcaccgcagttgtttctgcattcgaatgatcatccatgataaaaagctcccaaagatcatgcgtttgctgtatcacgctttcgatcgctttttgcaaataatcgggtttgttgtaacttgttaaaataatagacactttctctcccatctataccgcctcccgccgtcaaacataaaaacggctccgcagcaagcagagcctctgtcatcatttaaaaagcaccccagcttacaacacttgagagtgaaacatgagatctcgtgttatttaacgggttttggaaaataaccaaatcagtcagaacttcttttacgatgacattttgaagtgtatctccgttgatcaaattgacttttgaaaccggtacgcccagctcttttgcaaaaacaagctggcgtctgaggtcagatggatttccttcagaagacgattgacgtataagcagaatcagcaaaagcaaaataaaatgcagatcatcttggttttcttctcgatccacttgtttctctaaatccaaatcatccctctcccttatccttatctctgtttcacaatatgtgcgacttcgatttatggtataggctatgtccactccattaaaaaatcagcattttccttaaatagatgaaaaatagatcaggtacggcgttcgactcataccaaataacagccggaagaatatgaataacgtgagttcactatcgaataggaggtgtgtgtaatgagctctgaaaatgcacagttaaaaaaggatttaattaaagccgttttaagccctttatttccaactgcaacagaaggaggagaaaatatggatagtaatcttaaagccttgcttgatgctgccatcgatcaaaaagtagatgaaagtgaaacggttacggcagaatctattttagacccttctcttccggcaagatggatttttgccagaattacgccaggcacgacaatcagcattgtaaccgattcgggagacatgatcgggccggttgtcttcgttgctttcgatcaggttcacgggatcgtctttgtaacacaggaaagttccgtcactccagcaggccaagctacaacattaattgatgtagacaaagtagaaagcgttacgtttttttcataacatccgatgaaagtgttgtatatccagtcgggatacggaggaatatacagttattttgatcgctgggctgaagaatgttttcagaacactcatacagagtatatgattgcagataaacctgaagcagaatctttgatgaagatcgaagcgtttcagccggacttcacacttatgatggttggagaccgcgttcctcacgactggctgacctggttaaagggtaaggatatccccgtgtatgtttggctgaccgaagacccattttatatggatatcagccttcaggtaattaagcttgctgacgccatattaacgatagaacaaaatgcagctctctactatcaagagctcggctaccagaacgtctattatgttccgataccagttaaccatcggctgtttaaaaaaatgggcaccgaacattcctatcattcaaatctgttaatcatcggctatccttaccctaatcgggttcagcttatgaaagaagcggtccatctgccattcacggttcgggtaatcggtaaggaatggggaaaatatctgcctaaaaaagtgctcaaacagccgcatattgatgtcgtcagcacatgggttccacccgaacaggccgttcattattataatggggcagacatcgtaattaatgcgcatcgtccctatcattttgctttcaaccaaaatactatgcgcatcaaaaatgccagttttaataaccgaacgtttgatatcgctgcatgcgaagcatttcaattaacagatttacccgcggcgcatcctttttcatcctttatttcttatcacggcatgaacgactttaaggaaaaagccgctttctatatcaaccaccctgaagaacggcaaaaagctgcagcagccaattataaagagatcgtacccgcatttacgtttgatgagcttcctgcaaaactaaaagcgattcatctggcgctctcatgaaaaatcgttcattgctatgaacgatttttttattaatagaaaaaagcagctgcacaagctgctttcaattctagccgtcagaacggtctttcagcttcctcggatttacctgtttatgaagatcaggcatttcgccgagatgctgtgcaatttgttcccacgatacaattttgaaattttgattgacggcttgtccgttatcgatattttcgccatcctgcgccacaaaaatcccgtacggatattttgggccaagtccgaaaccgagaacatcaataccatccgtgtcactagtaccgtctatcttctcgccatctgtaatctcaaaattggctacataacgatttttcccctgccgttcatacattgcatagctgttatttccttgacttgaagccatgagatatcctttgccatttggtgcataatagattgtcagtccttcaatatcagctgtcaaatgatctcctgtcgcacggtcaactacctgcccctttgatcctccgccgggctcagcgttaaatttccagatggcctcatcttcctctgctatgtataggtttccgtactcatcatccgcaacaaggccttcggtctgagtattcaacttaaattcacgcacctttttccctgttacataaccctttccaccatcaacaatttcatactgctcaaattccccttgtttgcctgtcactaatgcgtaaaatgctcctgttttctggctgtgatacaagctgaatccataaacctcagaaatattggtggaaataggatgtttcggatctgtaatgcttttcaattttcctttatccccatctattgcatatacttcaattgtattttttccttcggaccgattggatgcggcagcaatatcaattttttcgccgttcaatggaaaatcatagcgcagatcgacattattgagcttgccaaactcataagaatgaagctgttttccgtctaaatcatacacgacgagccctgacttcttatttgtcgtaatcaacttgcttttttccgggtgtttttcatgaacccaaatggccgggtcatctgctgcgtcatcgccagatgcgaccggatctgtctccgtgtgtgcagtcactttgaaatgatgttcctcattcacataatgagccgacacagaggttgctgtcaggctaagcaataaacccgcggcagtgcttagcagcattgtttttgaaaccttcatttggtaccctcctcttttatcactatcactactattgtaaaatatatacaggtgattaccgtgaggaaaatgaacctttttttatagggtttctgactcataaacaacttttccccaaagaggtacgtgagatggactttgccagatttccttttgcggagcgaaataaaaatatgttgaatatttagtacattgtttatttaggtttgttgttccctagttacgtccgtttttccattttctattaaaaaagaacactttgtgacatgatcattcccctaaattttgttttattggttgctttcattaattcgattacaaagttgaacatatgatgcatggtagagaaacgagagttggaggataagccatgcctaaacagcaaacagcagaactaaaaccatttttccataacaaaacagttttagtcactggcggaacgggttcaatcgggagtcaaattgtcaaacgccttttgctgcttacacctaaacaggtgattgtattcagcaaagacgacagtaaacagtatgtcatgagccaaaagtatgcggaggataagcggctattatttgtactcggagatatacgcgatcacagaagggtgaatcaggtgatgaaaggcgtcgatatcgtctttcacgcggctgcgctgaaacaggttccgacatgtgaggaccatccatttgaagcgatccagaccaatctcatcggcggacaaaatgtggtggaagctgccctttcacaccgagtgcagcatgtcattaatatcagtacagataaagctgtatctcctgtgaacacaatgggtgccaccaagctgttatctgaaaagctgtttcatcaagcaaaccgccacgtccaaaacaaaggaaccttgttttgttcggtacgctttggaaatgttctcggttccagaggttcggtcatcccgatattatttgaacagatgatggagggtgaacctctgaccatcacagacaaaaacatgaccagatttttcatgtcaatagacgatgcagctacattgacattgcaatcagctgctattacaaaaggcggagaaacctttattttcaaaatggaatcactgaaacttgaagaactgattcatgggtttgaagaatatgcatcgcagcacgggctctcgcggccggctgcagtagaagtgggcaagcgtccaggtgaaaagcttcacgaagaattaacatctccacatgaaattgaatcactgtatgaatggggcaacctttatgcgatccttccagagccggaaaaacatcctgactttcgcaaagtcaatctgcctgggtatcaatcagatcaagccccgctcattacgaaagaaaggattgctcagattattgaagaattgcatcaagagaaaaaggcataaaaacaagcctgtctatccattaggcaggcctgtttttaacactttatttattaaagagatgcagatagctttcgtatccttcttctttcagcttatgcttcggaacaaaccgcagcgctgctgaatttatgcagtaacgaagtccgtttggccccggtccgtcattaaatacgtggccaagatgagaatcagcagttcggcttcttacttctgtgcgaatcatgccgtggctcgtgtccagtttttcttccacttcttcttcttcaatcggctttgtaaagcttggccagccgcagtgggaatcaaatttatccttggatgtaaacaatggcttgcctgacacaatgtctacatacaacccttcttccttatgatcccaatattcattttgaaatggcggctccgtgccgttattttgcgttacttcatattgcatgcgatttaatgacttcaatttttcttctttattgtacgccatttatttagccccccaatgctcgctgataaatcccgctcgtccggaacctgtccggtagcgctgataatgtgctggattctttttataaaaatgctgatggtagccttccgcttcatagaaaggttcagcttttaaaatgtccgttacaatcggatctttaaagatgccgctttccgccagacgttgcttggaagcttccgcaagctccttttgtttttcattatgataaaaaatggctgcgcgataggaactgccgcgatcagcaaactgcccccggcatctgtcggatcgatttgctgccaaaataattcaagcagtttttcataagggaatacatcaggattaaacgtgatttgaacggcttcacgatgtcccgtcgtttcactgcacacctcttcatacgtagggttttcagtatggccgcctgtatacccggacaccactttttcaattcccggctgttcgtcaaaaggtttaaccatacaccaaaaacagcctcctgcaaatgtggcgatttcttttttttcagacatactggtgcctcctttgttaatacgtggtattattatattatagcatgtaaaaatagaatgaaaatgattctgcttttcaataaaatctataggttttaagcaatatgcttatgtaatggaggttcacaaatttgaaagtaagaacacagatgatgtacgatatggaaactttactccgtaaagtctttaaacaaatacgcaatgaaatcaatgaaattttagataaagagctgtcgcggaatgaattcaccattcttcggatcctcagtgaacaagggcctaaaaaagtcactgaatttgcgcctattttagaggtatcggcaagccacattacggctgtgaccgatgcgctggtagaaaaggaatggattacgagaatcagatcgaaggaagacagacgcatcatccgcattcatatcactgaagcgggcgaaaaagtccttcagcactttaacgagaaaaaaacggaatatttctttaaacgctttgactgctacactgatgctgaacttgccacgttaatcgagctcttcagcaaacttgataaaaaacggtgaaaaaaagcacataccgatatataggtatgtgcttttcgcagtgcttcacttatttttcagtaaacagcttcattgctttccagcggccatatctataatacaaaaatgccgcgcagctgctaaataaaaaactcattccgattccaagcccgattcctttttgtccaagccaagctgaaaatagagctgtgaaaggatatctcaacacccaaaacgagattaaatttaataccagaacctgcagcatcgctcccgcggccctgacgattccgttcagcacaaaattaatcccaataaaagggtagaaaaacgcgatccacttcaaatattgttcaccaaatgcgaccgcatcgggctcactgataaataaccttatgagatatttaccaaatacccaaatcataaccgcaatcaccagcatgcaggaaataacagctatcacacccagccttgcaattgttcccactcttttttcgtttccgattccaatattttgccctgccatactgttgacggccgtaccggcagccattgctggaagcgtgatgatgctatcaagccgctgcaccgcgccaaagcctgataccacgtgatctccgtatgagttgacaacactcataatcgccatcataccgcctgtaatcaccatcatctgcagacctgccggaatcccgagtttcaaaatcagcgcggactcttcccacttgggcattctcggaatcgagaatggcacaagcttgtgtttgatgacataaaacaacccatacagaaacgcaatgccctgtgacaaaatcgttgaataagccgctcccgctattcccatgcggaacacagaaataaagagcggcgcaagcactgtattcagtacaacagcaaacgcaataaaccggagaggtgtcttgctgtcacccagcgcacgaagcacagtactgataaagttataaccaaacaaaaataaaatgccgataaattgaatctgtaaatacgtctcagcaagcggaatcattgactccggcgtttttagaagacgcagcaaaagctctgagagaaaaaaaccggcaacgccgaatccgatgcttaggcctgttaataaaacaacaaaagcgttaatatacgacgccattccttttacatcatcttttcctttttgctgagataaaatggttaacgtcgcattgttaaggcccaaaataaaagacagcacggtcaaaacaatcgtgcttgataccgcggctgctccaagggcctttgcccccagtaaattgccgatccacaagctgtctataaattgaaaggaaacctgtaatgcgtttccgagcataataggcattgaaaacagtacaagctgtttcagcacgttcccctgtgtaaaatcgtatgctttcatcttttctccttgtgttctcaaattttcttcggaccgcacgaaaaaagagacgttgtttcatgtctcttttttcatgacttatcggttttttttcggtctcgcataccgaatgtaaacaccatcacacttaggaacaaggcacaataggaaacattcaaatacatttgatccatgtcttcagcagtcagatgatgataagcaagccagccgaagtacagggaaaatgtaaaagataataaactgaaatactggtaaatccgtttcattttcagtcacctctattgtttgggatggtaataggaaaactcaatttcatctttttctaaatttatcttatccgctttgacatacattccattcgttaaaggcatttctgacaaacgcacttcaatgcttttatctccggggtgaacatggacaaatgacggcaattcataaaagctgtccatataatttaacacaaagctaattggtatactcaatttccctaacgaaaatttcgtgacattcagctctacatcaccgttttttttcacggtcggctcaaaagcgataaacgcatcaatagacgtggaaaatgccttgattttccctgcgacatgaacatcatcatcaatctctactttataatcaagcttgtttgatgctttgtcgtttaaatatgagttaacaaacgcagctaatgattcttttgtgcttgtcacttgaaatccatactcgctctcagatgaatccttcacctgagcctgttcccccgggagcaaaacaagtgccacaaacccggcggcgaggataaaattgattgcaagcaatataaaaaacagtcgcttccacttattcatgctgtcaccctactctttcggtaatccttcttttttaatggcttgatagacgcgctttgcgataagagaataacccgtaccattaggatgaaaatcatcttcctcagaaattcggctgctgtcacttttttgattgaacaaatcttcgatatgaacgatttttgcatgtttatcttttttcagctctttttcagcaatatggttccaatccgtgacgacaccatttatttcatttagttctgataatgtaaacgtaaacggattgtacatgctaacataaatcagctcagcgtgatcattcagctcgcgaatttcagaaatgattttttcaaagcgcttttcgtacggtttttccgcttcctgaaacggttcaacggttaattgcagaaagttttggcgaaggattttcatcaaatcattaccgccaattgtaaaaaagacataatctgcgtcctttatgcctttttgaacctttttatcttttagtttttctaataaatcatccgaacggttcccttttacggcataatttttcacgtcgaccgttttgacttgtttatctgaccggatagaatccgccaccttgccgacatatccctttccgtcgggatctccgactccttctgtcagcgaatctccgacagccgctatgacaatgtgttcttttgttttcgtttcatgggctttttgttttccctcagatgatgtacgtatgctcgtacacgcagtaagaagcaaaatcaaactggccatgattgaaaaaatgcgcagcttcaatcttgttgctccttcccattctactagtggaaagtgtatcatgttttagaagatttgcaaatgcctagtctcttagcttacttgagtgtactggctgacttcacatcggaaatgatatcatcgtacggtgtattctccactccattgtaatctttcagcaccttaccgtccggacctaccaaataaaaagaagattgatgaatcacttggtcctctccctccggcttctttacgatcgctttaaagctcttaagtgcgaactcctcaatctcactctggctgtatcccgtgagaaaatcccagttatcaaaagataatggataatttgcggcaaatttcttcagctgtttcggcttatcgttttctgggtcaacactaaatgatatgatgcggacgtctatattttcagctttcagttttttttgcagatcggtcatatgagcggtcatcggcggacatacagtttcacaattggtaaaaataaaatccgccagccatacttctccttttaaactctctaaagaaacgttcttgccgtcttggttttgaaatgtaaaaggctccacctcgtaattgagcggatttttaatctgctgtcctccgcatgcacacaaaaacagaaaaaacagcccagccgttaaccccttgataaccttcatgacatccaccctttccagccagcataaaaacgctttctaaaactgtccttactgtccaatgtttgtattcgatactgagcaaaaaaaatcctgcatgcctccccattaacgattacaaaggaggacatacaggtaaaaaacggcatgttacgcgttgtgctttaacatctcttgatgaaatacagcctgataatctgcccacttcatccggcgcttcatataatgtcggaaagaatacacttttgccctgctgtttgatgaaaacacttcttttaagtagaattgcaaatggtgatgtaacataaagaaatagtgctcatcttcctttaatacaggtatttctgtcactttcacctgaatcccgtcaccgcgtttgaactctaggcttttgagtaacaagctatcaatcctctttttttttttcttctattatatatgatgccagccgggctgtctgtcattttgcgcggttgtgtaaaaaaattagatcagcaaatggaacaagtcctcatccttgttcacctctacataatgaaacggttttttgttcatccgttcaatcagcggcccataatcggctttgttctgcagctcgatgccgacaagagcaggtccgttgcttttattatttttcttcgtatattcaaatcttgtaatgtcatcattcggcccgaggacttcgtcaagaaattcgcggagcgcccccgctctttgcggaaagttgatgataaaataatgctgaagaccttcaaaaatcaaggaacgctccttcatttcctgcattcttccgatatcgttattcccccgctgaccacacacaccacattttttcctttgatttcatccttgtacaaatcaagcgctgcgacagaaagagctccggccggttcagcaacaatcgcacattcgttatataattcaagaatggatgtacatacttttccttcaggcacaaggagaatgtcatcaacgacagtttccagcgtctggaaggtttcctcgccaatttttttaacagccgccccatctacaaacttgtcaattttatcaagtgtgacgacatgcccagctttgtttgattcaaagtaggatgccgctcccgccggctcaacagcaattacctttgtatcaggagacacgtttttcaaatatgtacctgccccagagagaaggccgccgcctccgacacttgcaaaaagaaaatgcggttctgcatcaatgtcgtttaaaatctcgactgcgagcgtcccctgtccggccatcacatccggatcatcgaacggatggataaacgtccgagattcagcctcacagcactcaacggcgcttttatacgcgtcgtcaaacgtatcacctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcacgttttaaatagatattgcattcatatctctcagaaagtctgtcattcctctgcaaaggtgtgtgaatgacaacgtcctttacgttttggtgagccttcaaaatgtctttcacttggatgagagagttttctttcaacaacggtttcatgtacagattcctttcttgttttaaatccctatttaatatgccattataacatgaatattcaaaaaataagacaattatttttatttaataattaaaaaaatacagactatgtccaccacatcttgtggtaacttctgttcaaccattatcctgcagagccaagaaaaaagatgatcgtaaaataaagggtgttttcaaccaaaaggcatgatataatgaaaccaattagaaccaaaaggagccaattgatgaatagtgcaccaaaactcaatacatttcaacatctaatcggagaacatcaaactttcctggaagcgaagcgaatcgccaagcagttctcgttatcggagcttcctgtcttaataacaggaaaaatcggaacaggcaaaaatcacttcgcacatgccatacacttggaatcttcgagaagcaatgaaccgtttataagcgtcaattgcagcacccattcggaagaaacccttattcatgagctttttggccctaacggaaacacaggtgtttttcaaaaagcagtacgaggaaccctttttcttgatgatgtatggcgcatgcctgcttctgtacaagctcagctgttaaaagcgcttgattcagacacggagaaaccgcgaatgatctgtgcttctgcagaccgatccgtggaacataccttcaggcaagacttattctacagactgaacattttaacgctcacactgcccgaattatcggaacgaaaaagcgatattccgcttttgacacagcattttctctcaaattccggtcagcaattgttaatcgatccctccgtttttcccgtgcttgagaagcatgcatttgaaggcaatgtcagggaattaaaaaacgctgcagattatatggcggcagtatcaagcggaggaacgattcagccatatgacctgccgccatatattagaggcgcgatagacggaaaaacgtcgaagaaaaaagcgaagctgctgactttaatggaaaaagctgagtttttgtttattttggaaacaataaaagtattgaacgaaaaaggagaacctgccagcagacggatcatttctgaacacagcaaaaatacccaaacctcgttaactcctcagcaggtcagaagccgtctcgactatttggagaaaaaagattatgtcaccaaaagccgcggacgcgcaggcacaaaaattacctttgagggcttgagctttatagagacgttaaaaaatcaaatgatctagcgatcgaaaggagaatgtacttgtttacaatcaaagaagagatcgccaatgcgattacacacggcatcggtgtcctcttatccatcccagcattagtgtttctaatcatatttgcggctaattacgggtctgcatgggacattgtcagctttacaatattcggtgtctctatgctgctgttatatttgagctccaccctgcttcacagcatcacacataaaaaaacgaaggacattttggagattattgatcatagcgcgatttatgtactcatcgccggaacctacacgccttttttgcttgggccgctgaaaggcacactcggctttaccctgttggttatcgtatggtcacttgccctaggcggaatcgtttttaaaattttctttgtgaaacggtttatcctattgtcaaccttcgtgtatttagtcatggggtggctgatgattattgcagttaaacctttatatgcttcactgagcggagcgggattcagcctcctttttctcggcggcattttatactctgtcggaaccatcttttacatttggaaaaagatccccttccatcacgccatttggcacagctttgtattgggcgggagcgctgccatgtttttctgcgtgctcttctattgtgtaaaggtgccgttcctttcgtagcagtaacagaaaagcgcagtcttcacgactgcgcttttttatgcacgtaattgtttttcattggcaggtatataagcttttgaaaaggacaattcaatgtctgccggttttaagcgtttaaaaaacgagcccttttgcatgttatctgttcctttcgtttccaccatcaccaacggaagatgatagcgggccgcaagttctataggatcaatagaaccatctagtgaaagaatcaggctttgtcccttttccagctgttttgtcacatcttcatataccttttctgaatcaccgtctgaaatcacatccatccgatccagccattgcccgataaaaggcaagcggaacacttttgggttggcgataaagccggccggttcctcaatatatccagcaattaaggccagttcagccaaacgcaaacggggatgcacatacaaaacaggaccgtgtggtattggctctggctgatggattgtcacaactgaaccggagatgccgatacagccttccaaaaacgcctttggctgttcgtacacaagagtcatctgttttttgtatgacagacggggatcgagcattgtttgattaaataattgtttcatattttttaacagcatatacacaatataaaccactagaaggctgtagcgaaccaattaaaatcctcccgctttagaagaattctttttttcatacattagaaattcgtaatcatacgggtttttttcgtctttgatcccctgctcagaagaaaccagcttccaattggattcatcaaattcagggaaatgacggtcaccctcaaactcgtgatgaattttcgtcatatacagtctgtccgcataagggaacaggtccgtatagagctgagcccctccgatcacaaagcattcttcagggcctgaacaaatgtccagtacatcctttaatgaactgacaaccgtgcatcccggaaattctgaatccggcgctgaggtaacgacaatatttttccgatttggaagcggacgtccgatcgattcaaatgttttccggcccataatgattgaatggcccgatgttattttcttaaagtatgcaagatcattgggcaaatgccacggcaaatcattgtctttgccgataagcctgttggcatccatcgcaaaaatgaatgaaatcatacgctgaccgccccttttatatgaggatgcggatcataatcctcgatgataaagtcctcaaatgcaaagttgaaaatagaatcaacctttctggcgaaacgaagctgtggaagcggtctaacatctctttccagctgcaaattgacttgttcaatatgattttgataaatatgaacatcaccaaacgtatggatgaactcgcccggttcaagcccagtcacatgagcaatcatcatggttagcagggcataagatgcaatattaaacggcacacctaagaaaacatcggcagagcgctgatacagctgacaggacagcttgccgtcagacacatagaattggaacaggcaatggcacggcggcaacgccattttatcaatttcaccaacattccaggcgctgacgattaagcgtctggagttcggatttgtcttaatatcttcaataagacgggaaatttgatcaatggtttctccatcagctccccgccaagaacgccattgggagccatatacaggtccaagttcaccgttttcatcagcccactcattccagattcgcactccgttttcctgcaaatagcgtacattcgtatctccttttaagaaccacagcagttcatgcgcaattgatttaaagtggagttttttagtggtgagcatcggaaagccttcccgtaaattaaatctcatttgatatccgaaagtgctgattgttccggtccctgtccggtctccctttttctcaccatgctctaaaacatgtctgcataaatccttatactgtttcatttttttcatcctttaaaagtagtcttctagtagtgtaacacaataaaaaatcatttctgaacccagaaatgatttttttatagtcagctgacgacaggcttttcatcctgttctttttcttcatcttgcagatcctgatgcgtatgtgcaattctgctcgccgctgctgcagcaagagctgccacaatatcatccaaaaaggtgtgaataccgtctggactttcatcaagttccttaataattccaatcttctctttatccaaataaccgaaattggtcaaaccgatcgacccgtacacattaacgattgaaagcgggataatttcatctatgccgtaaagcggttcatccgtttcaacaaggtgctgcagcggttcggggagaagcttctgttctgcaagctgatcgagtgcaagtcctgtcaaaacagcatgaataatttcacgtttgttcaggactttttctacattctccatgcaaacactgagcggcagatttggattgtattttccctgaagtttttgaacaatccgcgcaatatcttctatcataacgccccgtttgttcagcatatcctttgttatatcgaccatttcattcattgtgtactttttcatgtctaatggcatctcctttaggcactcatccagttgggaggcgtgttgcggtcccagtaaatgctcccaagctcatgatgtgattgaaatccatcttctgctgtatgataatgaaaattaaaccagtagccgtcatgcggcggatggtctcttcgcacatggaatctgagaagatcttctccagttgtccgattgtaaacgttgaaaattttttccgttttgcccgctgaaggcatgcttgagatcacaacatcttggtacgcctcatcatcttgcaatgtcgctaaatattcactaatcacattttcgatttttggcaggatctctttccgatagtcatcctcaatgaccggagcgattctgctgccgaattttaaaaaggactgatcctcagcgctgtcaaggagctgttccttgtacgattgaaaaagcagttcaggattttgcctgtcatccgactcatcatcgtacaggtcatgctcatcataaaaagcggtgtaatcattctgctcaagactgctcggctgtccggaaggcttgtccgccataagggcagccggaggagatacgagcccgaacgttacaatggtaaataaaaccacaagggtctttctcatccacaatttcatgactgcttattcctctctattttattgtcatgtttctcttattttagcacatccaaaacatgcaagtcatgtactatatgaaactgatatgcaaattaggagattcgttgctatgcactttgtgtaaaaacgcttacaatattccatgaaaggaggctttccgcatgattgacgctctgtttgccacagtttcactcttaacattattatactttgtcgtcatggaggtcaccgattaacagaaagcccgtgatatgaatcacgggcttgtttgaatgacgccataatggaacagtgctgtttttcttttcatgacgttaaaaccaaactgttcaaaccgcgggcttttccagtggtcttttagcacaacgctttttctggcgactcgtaccgcttcattgatacatccttcgtgtaaaactgaatcctctgccaaatcacgtaaaggcgcgatgccgtcagaggtctctacaggttcatgaaacattggatcgaaataaaccacatcaacagagttgtcaggaagctgtttgatgaattctaagcaatcaccattcttcacctggattcttctcatcgcagcttgaagctcttctatacccgtttcccatgaatgcagccccatcctcactaaaacagacacaagatggtttttttcaatcccaacaacagaacccgtttcgcctactgccatacttgcgataatggcatctgaccccagcccgagtgtgcaatctaaaaacgtatccccttcagataagccggcagcccgaagcataggctcttgctctccctgtaagaagcgtttggctctaaacatcgctgtattcggatgaaaaaagaatttggcaccttgtttcgtatacagctcaaaccgctctttgccgaccacaagcaaatcacgttcagctgacctcagcaggtgttcaaccgtttgtttattccggccgcagtatggcatatttagctctttagaaagctgctttgcggtttttatggtgtgttcagacggtctatagcttgttgttatcatcttctgtactcccaaaaagaaaatgcccggaaaacgggcatttagcagtgcgcatcgaaggcagcagtcagatttttcatgatttcttccatatcgtgtccttcaatttcatgacgcggaataaaatgtacgacttctttgcctttcaaaagagccattgatggtgaagaaggctcctggccagtaaaatactcacgcattttcgcagtagcttctttatcttggcccgcaaaaacagtcaccgtattgtcaggtgttttgtcattctggaggactgcctgtgtagccgcaggacgcgcaaggcctgccgcgcagccgcatacagagttaacgactacaagagttgtgccctctgccttttccataaagttttctacttcttctgctgttgttagctcttcaaaacctgctccagtcagctcgcggcgcatcggtacgacaagctggcgcatgtattcttcataagccattgacataaaaaaagccccctctagtatccttcatctgaagtaaaggatactatagagagggccggatttcaaatgttcacgccttaaaatatagaagtaagtgtccccagctgtctagattttcataataccgccggtgttggcacttgtcacaagtttagaataacgtgccaggtagccggttttcactttcggttcaaaacctttccagttcgcttttcgtttttcccactcttcttctggcacttgtacatccaagatacgtttttcaatatcaacgataatatggtctccgttttcaacaaaggcaagtggcccgccctcagcggcctcaggtgatacgtggccgattgagaggccacgggaggctccggaaaaacgtccgtccgtaatcaatgccacttttggtccgagtcccattccaacgatttgggatgttggcgccagcatttccggcatgccaggtccgccttttggcccttcgtatctgatgatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcgtctaaatgaagcgctccttctttcttggaaagctcattcagagccgctgacacgccgcccgcttcatgaagatcttcaataaacacatccgatgcaggcgccagcttggccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacgatatcacgcggtttgatatctttgcgaatcgtttccattaattgcgcagccgattttctcacaaactctttgcgttccggagatgtcgccagaatggttccattacccggcaaagcaagaccaagtgcttctgacagacagttcattgagttcgccgtaaacatgcctgagcaagatccgcacgttgggcatccgaactgctctagttcttgaagctcgttttcgttgattttccctgcttgataggcgcctaccccttcgaatactgaggaaagggagatttttcgcccgtcacttgttcttcctgccgccatcggtccgccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggcacgccccctgcttctctgattgcttcttttacgattttcccaaactcctgcaagtgaacatgaccgggaacgatatcaatgtatgaattacacaccgcaataaacggcttgccgaaatcctcttcttttactcctgctgcacgaagcaaactgcggtgcggagctctatcgattccttgtgtgatcatattactgcgtaattctgccatggtgatcctcctaaattctttcaattgtttgattggattttattttgacaattttcagtttatttatgagctgtttttgcaaataagataaattcaggccgccctcaccttgttttgttctttcgtgtttttatatttatatagctttctttcgatttgaaccctccaactattaatattgttacttactataaatagttttcggatatttttcaacaatattcgaaataatttttataaaaagtgaattcacataaaaaaggtgcatgatctgcaccttttttatttctattcgcctttttttctgctttccgtcatttgtttccaaacagaaccttttgcttcttctccatgctcaatacgttcaagcgccattttgacttgaaggctgacctcaaattcgggatcatcttcggcagcgcgcaaagcttcaattgcactttcatcgccgacttcgtacaggaacatggccgcacgccagcgaacaagcttgctggagtcgcttaacgacttgatcatagcaggaatggcttgaggatcgccgatatcagacaggcagtctccggccgttcttctgactgatacagctttgtcctcaagtgctttatacaatagaggaagaacatcaggtgtttcaatcattcctaagtacacaacagcctgtcttctgatggacacctttggatcatccaatgccttctgtaaaaccgggatatcctcttctttcggatccatctgttccaagtgtgcataacgctttttccagtcctcatcatccagcatgtcaagcgttactttatacgctttgcgctgtacagcttgttttgcttcgccctttccttgagcggctgcttcagtcagtcgtttcagccgttcatcactgtatgccgcctgaagctcttctgtcacgtcatggccgatttcatcaaagtcaccgaatctgacaccctgttctttccaagcccgctcaaacacaacattggaagcttcagatctaagttttaagatcgcctgctgaaagcgttcaggtaagccgaagcgttcttcccgctctccatcggttaatttaacttgcataggaatgccgctgaacatctgcacaaaaacttttacctctccaaaagattcttgatcagaacgattttcttctgcgctttcagcactttccatcccaaatgcagtgcggacttgcggtaaaatgtctttccagtcgtatcttgcattccgttcaacagcaagaaaatctgcgacgtgatagacccctttaactccatctattttaaggatttccgctataacaggcggtgcgccttctgcttgctcaagtttatagttattgcttttgcccgccggaagctcttccgttaagatgactttcattgtattcgggcttggtgtaggttcaattgattttatcttcatgatcgtcctcctatagcatatctgtgacttattctatcatagtcgctccaagccttctattacgacgttttggcatcaatcccgggtatgtctttttctaattggcggacaaattgaagcataaaattgtgtctttcttctgccagttcccgtgcagtgtctgtattcatcatatctttcagccgcagcagcttatgaaaaaaatgagcgtaggcgctttgatcatctccataaaggccatgcccgtttgcgcccgcaaacatgagaactcgcgcaatgccgacagcaccaatcgcatcaagtctgtcagcatcctgtacggcttttccctcaattgagagcggctccttcgccagcttttccctgtctcgaaaggacatccttgttataatatgaatcaccctgtcagcattctcttttcctactccgaaaaaaacgagctgatcatatacttcgctcacagaaagcctgaccgtgtcaggcagcttcacatcaattaaatcatgaaccaaagccgccgtttcaacaatgaacaaatccgctttttccttttctccaatatacgctgcaatatctgctactcttgatacatgatgccagtcatgtccagagctttcgtcagtcaggatagattgaacccatgtcctgatttgctctgcctgcttcaattccttcacaaaaacaccctctttttattgctctaatagcttcacgatatcgtcttccagctctttcggatttgtatttggtgaataacggccaacgatttctccatttctatccactataaatttcgtgaaattccacttgatcgccttagttcccagcatccctttcgcatgttctgtcaaatatacaaacagcgggtgggcatttttcccgtttacatccacttttgaaaacataggaaatgtaacaccgtaatttgtttcacaaaattcctgtatgtcagcctcttcaccaggctcttggttcatgaattgattgcaggggaaccctaagatctccagcccctcctgctgatatgtatcatataattcctgcagctgctttaattggggagtaaaaccgcacttacttgctgtattcacgatcatcagtacctttcccgcgaaaggctgaagtgtcatgtctttccctgtgattgtacgtaccttcatatgataaatagacatgtaagcccctcctatgtccctggtgctgattattttaccttttttaaatcgcaattcaaaatgtaaacatcaattaagaactcataagaaacttaacaatatgaaacgtccgttcattatcaattcatatggctcattttttatcttatcattctataaaacattacaatcccctctgacatcatggaaaatcattttactgtgaaaccaaaaggcgtgtcagtgcgttttatttaaagagttttctgttgtttccccctcaacacgcatagatagattgaaaattggcgtgaaaattcctataatgaagaaaattaacggggaaataatggaggtggcacgttgcctattaatataccaacacacctgccggcaaaacaggtgcttgaaagtgaacagatatttgtaatggatgaaagcagagcatttcatcaggatatccggccgcaaaaaattattatattaaatttgatgccgaaaaaaatccaaacagagactcagcttctcagattgcttggaaattcgcctttacaggttcatttcacatttttaatcccaagcacacacacgccgaaaaatactgcgagagaacaccttgacgaattttacacgactttttccaatatccgtcacaagaggtttgacggcatgattatcaccggtgcgccgatcgagcatttggcgtttgaagaggtttcatattgggaagagctcaaggaaatcatggagtggagcaaaacaaatgtcacttcaaccttgcatatttgctggggcgctcaagcaggtttgtattaccattacggtgtggaaaaaattcaaatgccgaaaaaaatcttcggtgtgttcgaacataccgttctttcaaaacacgaaagattggtaagaggttttgacgagctatactacgtgccgcattcccggcatacagatataaatatggaacagcttcaagcagtgcccgagttaaacattcttaccgcatcaaaggaagccggggtttgcttaattgtgtctaaagacgaaaaacaagtctttttgacagggcaccctgaatatgatacaaatacgcttcttcaagagtatgaaagagatttggaacgaaacctttctactgtcgaggcgcctaaacattattttgcaaaaggcagcaacgagccagtgaatcgctggaaagcgcatgccacattattgtttatgaattggctgaattattacgtttaccaggaaactccttatgaatgggactaatttttctttttttagtgatacgctgagcaaaaaatatgataaaatacatctgattcagtctgcgtataacaaaaatttaaaatactggaatccaaatcatttaaaattagcttaactttttcactgcattaataattcgattatgtatttgtgttatgtttatgtatagacaataactccttacgatgcatgaagcttgcttgttgttgattacattgaggtgaatttacttgaataccaataaaagagtattaattttgactgcaaattacggaaatggacatgtgcaggtagccaaaacactatatgaacaatgtgtacggctcggctttcagcatgtaacagtttctaatttgtaccaagagtcaaatccgattgtttcagaggtaactcaatacctttatttaaaaagcttctcaatcgggaaacagttttatcgtttgttttattacggagttgacaaaatctataataaacgtaaattcaatatttactttaaaatgggtaataaaagattgggcgaacttgtcgatgaacatcagcccgatattattattaatacatttccgatgatcgtcgtgcctgaatacagacgccgaactggaagagtcattcctaccttcaacgttatgactgatttttgtcttcataaaatttgggttcacgaaaacgtggataaatattatgtggcgacagattacgtgaaggaaaaactgctggagatcggcactcatccaagcaacgtaaaaatcacgggaattccaatcaggccgcaatttgaagaatccatgccggttggcccgatatataaaaagtacaatctttcaccaaacaaaaaagtgcttctgatcatggcaggtgctcacggtgtattaaagaacgtaaaagagctgtgcgaaaaccttgtcaaagatgaccaagtgcaagtggttgtcgtgtgcgggaaaaatacggctttaaaagaatctttgagtgcgcttgaggcggaaaatggcgacaaattaaaagttctgggctatgtggagcgcattgatgagctatttcggatcacagattgcatgattaccaagcccggcggcattactttgacagaagccacagccattggagtgcctgtcattctgtacaaacccgtgcctggccaggaaaaagaaaatgcaaacttctttgaagaccgcggagctgccatcgttgtgaaccgtcatgaagagattctcgagtcagtcacttcccttcttgcagatgaagataccttgcatcgcatgaagaaaaacattaaggaccttcatttagcaaactcctctgaagtgattttagaggatatcctgaaggaatcagaaatgatgactaccaaacaaaaagccaaagtgctatcgtaatggcgtacttgagagcatacgaaaatcgtgtgctctttttatttatattcagccattaataaaagcggttacatttttttatgaaacttgcccttcttttgaaaaataagccgtttcgaaacttgacgggtgctcccagatggtgtatagttgaaccatcatttaacaatgaatcaaagttagatgatgacaaaattttttttagcacatgggtgctacagtactaggaggaattaagcaatatgcaaaacggtaaagtaaaatggttcaacaacgaaaaaggattcggcttcattgaagttgaaggcggagacgatgtatttgttcacttcacagctatcgaaggagatggatacaaatcattagaagaaggacaagaagtttcttttgaaattgtcgaaggtaatcgtggacctcaagcttctaatgttgtaaaactctaaactcaatacatgatgatgagatgacaaatagaggagaggcattcgcctctcctatttgattttcatctggatttcaatcgccaaaatgttttgtttacacctctgttcaatctcttcaacatacttttccattgatggttttccttttttcgcgatatccgccagttcttctaaatcactgtatatttctataaatgttttgtgaaggatcaacttcaagtctttatcatccatagctgcgttccccttctctatcaagatacctcaaatagtaaaacggtcctatttattctggttcaatagttatatcggcttatttttattttcttttctattttggtacataaatttcaaaaaaactctgcaaaataatggcggaggtgttttttgtgacttcagaatttcataatgaggatcagactggctttacggataagcggcagctggaactagcggtggaaacagcgcagaaaacaacaggagccgcgacgagaggccaaagcaaaacattagtcgactctgcataccaagccattgaggatgctagagaactgtcacaatctgaagagctggcagctctcgatgatcctgaatttgtaaagcagcaacagcagctgctagatgacagcgagcatcagctggatgaattcaaagaataaaaaccgcagcttctgcggtttttatttttagtgattggttaagacatctccgtattgtttcagcttttcaccaaccgtacatttattgatacaaaatgaatgcgcataagttttgccaaattctttgcgaaactgcttcttaataaaacagtccttgcaatattcatcgtgcagttctgtcagttctttaaagatcattttcttatccaatatcgtcatctccgttacggtctaatttcgtgtggctttctacgaattgatgggatagaatttttttagcgaggccgtcagcttcctgattgtcttttcgttgtattgtttcgtaggttggagtaagcttcagcgattcaaggagtgcttctattttgtccagccattcattatgagatggatcataacaaggccagctgccgtcaagctgattcagcacaacaagcgagtcccctttgattgtaattgaatttctgcttgccccaagctctcttacttctcttattgcttcataaagcgctgcgtattcagcttcattattggttttcagccggaagcttttattttttctcaagcgatgccgggttcctcccagtgaataatagatgacgatcccgagaccggccagttcgctctccttatcgaaactgccgtcaaaataaacagtaatgtcatcaggctcttgagcaagctcctctgtcagcttttccaattccttcagcatccagctgccgcctttctcgtcttcgaactctagctctttcatgtatggaaaacgtccaagttctctggcgagcatacgtgcctgctgtgctgtcagccagtcttcgctaaaaaatgagacggatcctgttccttttgcttctattttcaaatgcggtctgagcttcattacaatcaccttaccattcattagttgtcgggcttatgctataatcaaaccaatcttaccccggaaaggaagctttttcatcttgtttaataattcgttttggatcttttttgcgatcattcattttatcattgttcttttattttataaaggatttggcaaaatggggctgtttgtttggatcggttttgcgacagtctgcgccaacctccaagtcgtcaaaacagtggaactgtttggcttaacagcgacactcgggaatgtgatgtatggcacaatcttttttgcgacagatgtgctgaatgaaaaatacggaccagctgaagccagaaaagcggtatggctcggattctcaacgctcctgacgctgacatttgtcatgcagggcgtgctgcttttcgaaccggcttccagcgacatatcacaaacagcgctagaaacgatcttcggattccttccgcgagttgcgttaggaagtctgcttgcctttatcttcagccaaacgctggatgtttatgtatattcggcaattagaaggatatttccttctgatcggcttttatggctcagaaacggcggcagtacagcagtcagccagctgtttgatacattcatattcacttcagtcgcctttctcggcatttatccggcaggcgtgtggcttcatatttttatttctacatatttgattaagtttacggtatctttgatttcattgccttatgcttatgcagccaaaaaaatgatacctaaagatgaaaggagttcataatgcctacagaaatatacgtagacggcgcaagcgctggtaatcccgggccttccggtatcggcatttttatcaaacatgagggaatagcagaatccttctctattccaatcggagtgcatacaaatcaggaagcggaatttcttgcattaattgaagggatgaagctatgtgcaacgcgcgggtatcaatcggtttcctttcgaaccgattcagatattgtggaacgcgccactgagcttgaaatggttaaaaataaaacgtttcaaccgttcgtagaagaaatcacccgattaaaagcggcattccctctttttttcatcaaatggataccgggcaagcaaaaccaaaaagccgatcttctggcaaaagaagcgattcggctgaatgaaaagaattaaatcttgatcattggttcatcctaatggcgaggtgaactaacatgaaaaagaaagataaaggccggctgaccggcggtgttactccgcaaggcgacctggaaggcaatacacataatgaccctaaaacagagcttgaggagagagcaaaaaaaagcaatacaaaacgctagagaggatctaaacgatctctctagcgttcagcttttcaagcatacgctcaattcctttaatttggtggcggcgaagcatgtcagccgcctgctccatttgcaaagtaaataaagcgtctttcagtgtgcaggccagcggcactgagcaatggatttccgcaagcttcctcgacatctccaaatcgcttaaaccttgctgaatttttccctgctgtccttttggaagaagagaaagattttccaataaacggtcaatcgtttcatattcacgaatcagtttgtaggctgttttttctccaatgcctttgactccgggatagttatcactggaatcacccataagcgctttaatatcaatcaaagccttcggcattacgcctgtttcttcataaaaagtctcttttgtatagactttataatttccgattcctttttgaagcaaagcaacgcttactttatccgttaacagctgaagtaaatctctgtcccctgttacgaccgtaatgtccgcttcattcgcaaataaatcggcaagagtaccgatacagtcatccgcttcatagccggcaaagccaatattcatgattccaagctctgcggctgcttcctttgccaaatcaaactgcggaatcagctccacaggcggcgcgctgcggttggccttataatcttggaacaagtcatttcggtacgttttgctccccatgtcccagcagcagacgacgtgtgtcggctggaatgtttccacagctgtaatcaaatgctttaaaaagccgttgacgccgttcgtcggcaccccgctgtcatttatcataaagttgcgatgtacggccgtggcaaaaaaggcccggaataaaagagccatgccgtcaaccagcaatagtttattattattcatcaaataactcccttttctttcattccttctattttatcataaagcagcccaaaaataaaaaacagtatctctttaattagagatactgtttggatatttatcaatcgttgtgtcttttgttgctggcgatcagcttttcagcttcgcgtcctgcgtaagagtcaaaatgggtttgaaatccgtttttctttttggcattgttattcgcctgtgcatttctgtttccgagctttgttctgcccaacatgaatcccccttacgtcggatgcatatagtatatgcttccggcaggaggttcactcgcgacaggatcatccagcttacatgcggcttacgtattctctgaccatttcttttgatacaagccgtcttgtcgggacgatgccttttttagcgagctgattcatttgctcggtaatttcattaattgcatctgtagtataaggctcatcgtttctgcatttagcaacagcttcttcaatcgccaattcacgcatattttcaagacgcataaatgctttgatatgctcgtgctgttttgatgaatgtgctgaaattgctttatgtacctctgacattaatcgttcatctcgcttttttctatttagtctatcatgacttgaaatacaagccaactgaattttacatttttattgtattgtctgaatttttccaggaaatgcacgcctgatacgccatttcaatctctttcgcatgttccccttccgcatatcctcttaaatatgtctctttttgatccgttatttgcgcgattgctttttcacccatatcttcctgtaagcgtctgaggtgagcagtgtaatgagatatcaggctttcttcttcattttttatccatgcctctgtgattttcgtaagtttcatccgtacagcttcgataaaggccgcttttcctttctgctcaaaaaactgcttcggtgatttgatctcttttagttcctgctcaaaagcacgttcttctatttccggttcaacttccttcaactgtatgccgttcgaatgctgatcacccgcataaacggaaaaataaccgtcctcgtttaatgttttttgaaaatgatccagccattcttcattgatatgccgttcgatgaaaccgctcatgcgaacatcaagcgttttgatttcctgaatatattcaaattgatattcatgtatggctgttgtcatcgctttactgacgttctttttccaatccccgttttgcagcccgggatgaaatgccgattttaataaatcatttgcaaaatatgataatcgctgtgcaatgtgatatagctgctctcttgtatctttttttactttttcaatgatggtttttgagttccgccgtttctcgatatcggccgctgcctgctcaaatgacagcataaggcgctgtttctgcgcttccttctcttctcgggactgatgctgggattggtgaagctgaaaaacggtttcgcatagtttgtctgcctccgaactgagctgcgctgctgacgctttttttacgtccacttcgataaaccggtctaagtgttttcttacttttgagaactgattgtaaaatgactccggttttcccaccagttcctccttacttgatacggtaaagagctgcggctcataaaccccttcttttacaagctctgcgctgacataatcggtcactgtttcgagctctgttttatcttttgcaaggtctgcagcattaataataaaaaacattttatccatgctgagcgattctttcacaagtccaagctttcgcaaaaatgaacggtctccttttgaaaaagagtgctgataataagtcatataaaaaaatgcatcagcatctttgatatattggaatgccagttctgtatgccgtttattcatgctgctcgcgccgggtgtatcaacgatcgtaatccctttttcagttagcgggcatgtatagtagaccgttacctctttcacagcacaggccgttgtttcctctgctacatacggctttaattcagagatcggaatcgttaatttcttctgttcctgtatatactgctgatacttctcgtatgcaagcaggaaattgctgatcaatttcacgtgttcttcctgcagcctgttttttttgactgccttttcccacttctctgtgaaggaacggcctgccggttcctttggtattccggtgagctgcaaaatttcagccgttatgtcatcctctgtcttaaacactacatccgctgttttgtttaagttgccattgattggctttgtgatcttgttaattgtcgctgtggttggcgttggtgaggatggcagcactctttcgccgacaagcgcattggcaaatgatgatttccccgagctaaagcctccaaaaagagcgagtgtaaatttccgttcctcaagccttttcaccctttcacgaaacgctgaagtttgctttaacaacatgctgtattcgcctaaaaggtcagacaaagtgtaaaagcgtttgatttggtcttgaagcggcatttcttgttccattttgatttctgatttcggcatcggctgcgccgtcagctggcttcggccttgtttctgctctggagccgccactcttgttttcttcgatttaaaccattctgtgtctatatgcattgggcatgcggactcttcttcccaaatggcccacaggcgatcggttttctctcgggcattattctctaaacacgcctgttcttgaagaaatacaagtttttctgattcttggacgagccggtcgttaattgtttgcacatctttggaaacacgctctttcaccatagcggagagcacctttatgatgtctgcggcttctcttttcgcctctttcctgatgagctctgctaagtcttttgtatattgcaatacatattcagaggaaaaggctgcaccatgcttgaccgcgcgttcaatgatgcttatatcaagcggtgtgcgataggcctgaatcagcttttcactttcagcggtatagacatcaaataccttggcgagtttatgaagcgtgtctatcatatgccaatccgcttcggcctctgttcgttttgccacatcagagaaaaaagcattccgccttttatctctttcctgtgcagttttcgctttagaaaagaaaaagccggttttaaaagaaggctcttgtgattctaaaaatgcagccgccaattcacgcatttcaaaaggcgtcaggtttgcgttttttaaaatacgattgatttcttcctgcatcctcttctctgcctcagtcgtttgtttttcggcctcattcaattgatcacgcagcgattggaccagtccaatttggatattaagctgttcagcgaaactcggagcgcctgtttcgtctttcttcagcatttccgtatgttcctttagcagattacggactttttgttccgttaaagcctgcatattgctttttgattgctgttctattcttcttaactcttctctcagggcccccatctgattgaacgggtgatccggttctgttactgatgtaaaatagagcgcttcccttgaaatcccttcattgcaaagcatctcctctacctgcgcttgatagtctccaaatttcgtctccgtctcatcatggcggtcaatttgattgacgataaaatacacattctgaatgctttcttttattgatctgagaaactttacattttcctcagagtgcacgtgattatagtgaacgacgtaaaacagcgcatccgcttggtgaagaatagaagcagccgatagaaaatgagcatcatctgttgaatctatccctggagtatcaatatacgcaaccccggaatcgatctcagtatacctgtcaaaaatttcgacgctttcaatctgttccccgtctttacaatattgctgcaccttgtctttctggtaagccccttccagctcagcacacgctccgtctgttgtatgaagccgaactcgcttttccccgtttctgatcacaacaaggttagcgcttgtcggaatcgggcttgtcggcaaaatattctccattaacaggcagttcagcagtgacgattttcccgctgaataatgcccggtaaacgcgatataaacctcttcatcagccgcttttttcatgaccgcagccagtttagcagccctttgttcatcttgattctcaataaattgcttataaatttccccagttttatgcaaaagctcttttctgttttgatctgtcataagtctgaacccctttgtgccgtttcaattgtgaacctttttcgaaagatctgaattcattccctttacattttacacaagaataaaccaaatttctttaggagaatagaaaaaagccgccattacggcagcttctataaaagaaaatctgcaacttttacaagttccagattcatcaaacagatttattagagattccttttaatacaaaaccaattaatacactatatgtacaaaccgctccaagcaaaaacagcattgtcatttgcttcaccatcctgattgagaatctttttcaaattcattttaacatggttgagaatgattttcaatcgctattttacgctgtattcctgtaatgctttgtcttctgcgcgaattctgacgcttaacaacacggcattgaaaatggaaaacagacacatggtgacgtatgcttgataaagcagcggaatcagcaaaatttcgagtataacaacggcatagtttggatgtttcatccatttatatggacctttttttacaagctctacgcctggaacaacaaggattttcgtattccaatatgctcctaaggaacaaagcgcccaataccttactatctgtacgcttaaaatcactgcagcgataccgagccaccagttggacggctgtttattcatcagcagcacctcggcaattaaggacaggaaaaaaaggatatgcatcgtaatgatatacggatagtggctctcgccaaattcaattgctccttgcttctttaccttttgttcgttttgcctggccactgccatttctgctgctctttgaacaatgagaatggcgatcaacaaccaaaacatgagtcaagccccttttcccagctgaataacagcaactctgatgagaaacccggccctaatgcgccaatcattcctcgttcagcttcctttttatgtccgttctgcagatggtctttgatcacatacaagattgtggctgaagacatatttccgtgcttttgcaaaatgctttgcgcagatgaaagcttttctgacgatagcccgagacttttgatgtatgcatcgatcactttttttccgcctggatgcgccaaaaaaacactgatatcatggaatgacagcttatgtttgtccaaaaaaatctgtacatttgttttgagccatttttccaccaaggtcggaatgtctcgtgagaaaatgactttgaatccttgatcggtaaagtcccaacccatgacatcttctgattgtttcatcaaaacagattgggcgtccattatcttcggcgcaagttgcagctttgacatcctgcggtccgccttctctccgcataataaagctgcggcaatgccgtcaccaaaaagcgaggtgccgatcagattgctttttgttttatcttccggctggaatgtcaggctgcacagctcggcagaaatgacaagcacaaaagccttaggatacgctttgcagtattcggctgcacgcgcaagtccgctggctcctcctgcacagccaagcccccaaatcggaatccgcttcgtatatggagaaaacggaagttcattcataagccgcgcctcgatactcggtgtggaaaggcctgtactggagacgaaaaaaacagcttccactttctcataaggaatggcttcttgaaaaaattccggatgagagaggcactcacgaacagccgctctgctgtgtttaagtgtttcttctatgtatatttgatttttttcttcaaagctgtgcccctctttataccattcaatcggcttaacaaactgtctcgaatggatttgcccgtttttaaaggaggataacagccggtcaatatccttaaaagaatgctgaaacatatagcgggcgaactcggccgctttctcttggtttacattatacgcaggaagacttgttccaatggataaaataaacgccatgcgatcacctctttgcatacattgtgccgcaacaatcttttttatatgcaaaaaaactccgccgcggcggagttagactgctgttttttgttcagcgaggtcagcttcttgttctgattttttagctttagaaaaaacgttatatacaatatttaagacgactgcagtaaagctgcccgccacaatgccattcgttgtaagcagcgttaaggcactcggaagctgtttgaaaatatccggcacaacggtcacaccgagccccaatcccactgagcaggcaacaatcagcagattttcctgtttcgcaaaatcaatgcggctgagcattttaattccgtaagcaatcaccattccaaacatcgccaccattgcaccgcccaaaacagcggatggaataatggtcgtgaaagcagcgatctttggaaacagcccaaatgccattaggatcacacttgtgaccacaatgacggtattttttttgatccctgtgagctgaacaagcccgacattttgagagaatgccgtgtaaggaaaagcgttaaaaataccgcccagaagcacagccagtccttcagctcgatagcctttagacagatctttctctgtcaaacggcggtttgtcaggtcacctaaagcaaagtaaacaccagttgactccacaaggctgacaattgcaacgatggacatcgtaatgataggcgctgcgtgaaaagacggcgctccgaagtaaaatggctgaatcatttgaacaactgccgcgtccgaaacattatcaaattgaacttttcccataaaatatgcgatgaaggtgccaatcaaaataccgatcaaaatcgagacggacttgataaagccttttgtaaaacggtatagaagcacaatgatactcaacacggtaaaagcaagagcaagattggagagatctccgaaatctgcacttccttctccgccggccatgttattcatggcaaccggcatcagtgtaataccgataatcgtaacaacagagcctgtcacgaccggcggaaaaaacgatacgagctttccaaagaaaaatgaaataagaatgacaagaatgcctgaagcgataatgctgccgtaaacagttgaaaccccatattcagatccaatcgctatcatcggcgatacagctgtaaaggtacagccaagcactaccggaagcccgatcccaaaaaatcggttgctccacacttgcagaagtgtagccacaccgcacataaaaatatcaattgatactaaataagtcagctgctcgacggtcagtcccattgcttttccgacaatcagaggaacaacaatggcgccggcatacatggcaagaacatgctgaatccctaaagacagcgttttgccgaatccatttctcatgaatgaacctcctgtacgaaggacacttttccttcttctaaagactgaattcttgccaaagattccactcgatagcccagtttcacaagttcatctcttcccggctgaaatgacttttcaataacaatgccaattcccgcaatagaagctcccgcttgcttcacaatcgacacaagcccgtgcgctgcctgtccatttgccaaaaaatcatcgataatcagcacatgatcctgatccgacagatgggtcccagacactgcgatttggctttctgtttgcttcgtaaaggaataaacagacgctgtcagcaagttgtcggtgagtgttaacgattgatgctttctcgcgaagacaactggcacacccagcttcaagcccgtcattacagcgggagcgatacctgatgattcgattgtcacaattttggtaataccgtcttttgcaaacctggacgcaaattcgtcaccaattctctgcataagcagcggatcaatttggtgattcaaaaaagaatccactttcaatacctgatcagataatacgatgccttcttcctctattttccgtttcagtgcttccatcctgtctacctccgttatgagaataaaaaaagcattgcccgctcaaataaagagcaagcaatgctgatatcacaaaaaaccgtacacgtgcggttccattgctcacccatagtcggacatttacggtgcccggtagaaacttgcgtgccatatccacgcgattatatgagtgttcctattatattgtaataaattatatcaagattctaatctcttgcataggctgaaaataaaaattcccgaactttaattttgtttttttagatatcattcgtatttcaagggggttcgatataaaagagcctgacgacgcgccgccaggcttttgattatgacagatagagatttgaatatttgtttgataaataatcaattaaatagcgaacattcagctcttctcctgttgcatctttaataatgtctaacggctttttccgttttccgtgaatgtgcaccttttccgtcagccattgctttatcggatggaactctcctctttccaagagagcgtcaaattcagggagatcctcaagcattttttgtttcagctgagccgcatacatgtagccgagcgcataggatgggaagtagccgaaatctccacctgcccaatggacgtcctgtaaaatcccctctgcgtcggtctgcggtgtaatccctaaataatcctggtatttttgattccaaagcgacggcagatcttccacagacacttcattgctgaaaatcgctttttcaatttcataacggatgatgatatgaagaggatacgtcaattcatccgcttcgaccctgataaatgaaggttttgattcattgattgcccggagaaaatcatccagggagatgtccttgaactgttcaggtgatgcttcttgaatcttctgatagtacggtgtccaaaaatgtttgttgcggccgataaaattctcgtaaaataatgattgcgattcatgaattcccattgatgcgccgtctgacaagttcgtgccactgagtgcttcatcaatattttgctcgtatatcgcgtgcccgcactcatgaatggtgccaaagatcgccgtccggaaatctttttcatcatatctcgtcgtgacccgaacgtctcctcggttcagcgtagttgcaaacggatgaacggtttcatcaagtcttccgccatcaaaatcgtagccaagctcctgtaaaaaatacagactgagctctttttgcttttctttcgggaacgcttttgtaataaagcttgtatctggtttatttccggaagctgtcacctgtttaacaagagggataatcgcttccttcagctcagtaaacagctgatcaagcacctttaccgtgacgccgggctcaaacaaatcaagcaatgcatcataaggatgctcttgatatccccaatacgtaataaaacgtttattgaattcaatcagctgttctaaataaggagaaaacaagctgaaatcagattttcctttcgcttcctcccacgctgtttctgcctttgaacacagaatcacgtattctttgtattcagcctcagggattttcttattctcttcatactcttttttcgccagttccactgcttttttcgtatcttccgacaagtcatcaaatcgttcatacaggacatcgataagctccttcattcgatctgatgtttggatattgaatatatctgttgaaagctggccgatactttcggcacgatcctctgagccgtttttcggcgcgcctgttctggagtcccagtgcattaacgcaactgcttcgctgtaatgtgagattctttttaaaagatcaaaaaattctttttcatatgtatgtatctccatatccattccctccctattctagccgttccattacaggctaatggaagggggtatgaaagtcaaattgtttgtataaaaggctgccggtatgttttgcggcagcctttttattcagttgattgtcatttgattttttggcggaggtgttctccgctttttctgcttgatttttttatccacccacactgttgccagcggggttaagagcgaggtaacaataacacttgtcgcgatgattgcagttgccgattcagcaactggcgcaaatgaggcattcgcttccgctaatgcgtatggcacagctacagcagcccccgccgtagaagaagcggccacacccgcgacaccgtctccccgcgcgacaaaacgatcaagtaaaaacaaggaactgcccgataaaatgacgacagaaactccgataaaaatgccgagcagccctgattggatcagcattccaaaattcaaggtattgccgagcgaaaaggcgaaaaatggaatgatcgccggcacaaccttgctgaataagtctctgagatcgtgatccagatttccaagtatacatccaagtaaaaacgggatgactgtcgctgccagcgtttcccatgggaatgcggcaagtcccgtcacaccaaacgtcaccatggtcataaaaggaccagattctgtactgataaaggcgaaagcgcccgcatcctcttttcttcccatgtgattcatgagcgccaaatacagtccgccgttcgtttcattcattaccgcgacaattgctaaaacagaaaggcctgcaaaaaagccggattgtatgccatcgtctggtataaattgcgctgcgatcacgccgagtagcgccgcaaatccgatctttcccaataataacgtgattccttttcttgcgatatagcctgaagaacgaaaatcaatcgttgctcctacgcaaaagataaaaacacccagtatcggcagcgttccggtaatcaaagcacccgtaaaccctccaaagaactccgctgttccaggcgcaaacgtgttgagcgccgctccaagaaatagcggaataatcatcattccgccaggtacccgttcaattgtcgccttgattttcatattgtggattctcccatcctccggttatgaaaaaacaattccgcttacacttggaaaacagcctgcaaatcctcttttgaacagctgcccagctggctgccgactccaacggcgccagctccggctctaagccaatccggcacttcagacggatgtatcccgcctgtcggaataaaggtcacctgcgggaaaggacccgctaaatttttcataaacgggatgccaaacacaccgcttgggaacagctttaatgtcgtaaaaccgaatgtcagcgcttccataatttcgctcggagtcaagacgccggggatataatgtgtctttacaaaagatagatgttcagcaagatcagctgaaaaacccggactgacaataaactgcgcgccagcctcagcagcttccccagcttgctgcgcggtgatgacagtgcccgcgccaattaaaatatcttccctattacggaaggattcgataatatctgatgccccgggggtcgtatacgtcacttcaactgcacgaatccctttatctaacaaactctcaatctgctgacaggcctcctgcgtatcctttgaacgaatgactgcaatcagctttgcttctttcagacggttttcaacgactttggactccatattaataatcccctttcttttggtgaaccgttctttgagcagataaaaaagaagctaatttctccctggtcggcaaaccgtccatatcccccggtgcctgcacttgcaaagcgccaatcgcatttcccctttgcaccgcatccttgtacgacaaaccgtctaggataccgctgattacaccgactgcaaatccgtctccggcgccgaccgtatcaaccacccggtcgacccggcagccttctagaaatccttcacttgtccccgttttaaagtaagcgccttcttttccgagtttaatagcgacaaagctggcaccttttttcaaataatagtcggcaatgccttcaggtgttttttctccggtcaatagctctccctctgcgatacccggaaaaaccagtctgcaagcccagctagatcgttgattgtgtgtaccattgttgcttgatcaggccaaagcgaaggccttacattagggtcgaatgaaatggttttccctgcgtttctcatgtcgttcatgacatggtacgtgaagtctttcatctcggctgataaggcaggcggaatacctgtcacatgcaaatggcctgcgcattgaaaataatctctcggatattcagcagaagttaatgtgcttgcagctgagtttttcctatagtaggtaacttgcgggtcgccttctttcacttttgacttaagcagcagcccggtgggattttcgtcctgcgagcggatcacgcgggacacatccactccctcttttttaagctcttgtaaaataaacgttccgagctgatcattgccgaccttgctcatccatcccattcggaatccgagtctggcaaggccgcaggcgacattgctttctgctccggcaagccctttagaaaaagtggatacttcatgaagacctccatactcatttgcgtaaaacatggccattgattccccgaatgtcaccgcatcaagcttcatctcttcccaacctcctcttagttgagggcacctaggattaaagtgactttctcatgatgacttttgcctctaattcaatggtttgaggcgctcctttgtcaccttcaatcctttttaatacacgttccatcgccgtcctgcccatatcatgtgacggctgggcgatcgttgtaatgcctggaccgatcagtttgtaccactccgtatcatcgaatcctgcaatccctatatcttgagggatgcgcaggccaagctcttccatacagctgatgattttcagcataatcaagccattcaaagccagaatcgcttttttttgctccgacatttccttgtgaaaagaacgaagcgccgccttaagctgctccttgtcttttacgtcaatttcatgcaatctgacaagcccgttcacattttgaaccgaagccatttcctgatacacagctgctctttctgcacgagggctgatagaggaaatcggttcggtaaacagcgcgacatcagtataccctttgctgtacaccttctgaagaatctcttttgtgatccatctgttgtcagtcgttacggtatccagtttcagatccggcagtttccggtcaattaagattgttggaatttgctgttcagcaaaagcgcggagtacatccttgttttcccctgttgcgtttaaaatcaagccctcaaccgaatgggcttctagctttaagagcatttcccgctctttttcaggactgttatctgtgttgcacaccataatgctgtatccatattgatcacaaacctcttcgactcccctaaaagcagcgaccgaaaaaggatttgtaatgtcagctacaacaaatccgattaacttgcttttttttattttcaaaccttgtgccattttactcggccgataattcaattctgcgattgcctttttaatgtttttcactttttcaggagaaatcgcgtcaatttttccgttaatatagcgggaaactgtcgatttcgaaactcctgcacattcagctacatctttgatggttgtatggcctgttgttttctttttcattcaagtgctcctgtatctcatatatttgaaaccgatttcaaaaccgttacaacaaaagaataccataattttaaaatttgggaagagtttttttaataatgtgtcaattcattattttttcgttgactcttttcactatttatcctaaaattttctttgaaaccgttaccaaaatattttcattcaagtgatgctgaaatcctaaccaaggaggaaatataatggaaaatcgttattctgtacatcctgaacaagtaaaacgctttacaacagaggagcttcgcagtcatttcttaatggattctttatttacagaaaacaaacttacgatgtattactcacatgaagaccgggttgtcatcggcggagcggctccagggcaaagtgaactgaagcttgatgcaggtgattttctaaaaacagacttctttttggaacggcgtgaaatcgggattattaatgtcggccagcctggcgctgtcagggttggcgatgatgaatatgtgcttcaaacaaaggattttctctatattggaatgggcaatcaggatgtatcgttttcaagcctgaacggggaaaaagcgaagttttacttcgtctccgcttgcgcccacaaaagctatccgacacaaaaagccgccctacctgaactgacaccggaccgccttggtgatgatgcagcgtctaatgtcagaagtctgtacaaagtcattcatcaggatggcattaaaagctgtcagctgatgatgggaataacgatgttagatcaaaacaacaactggaataccatgccagcacacgttcatgaccgtcggatggaggcttatctttatctggatcttgaaaaggactcaaaggtatttcatttcatgggccagccggatgaaacacgccatcttgttgttggaaatgagcaggctgtcctttctcccgcctggtctattcattctggcgcaggaacatcaaactatagctttgtgtgggcgatggctggagaaaattacacatttacggacatggatctcgttccgatggatgggctgaaataagatgggttatctacatgacgccttttcattagaaggaaaaacagcgctggtgacaggcccgggaacagggatcggtcaaggaatagccaaagccctagccggggctggcgctgatattatcggcacatcacatacaagcagtctgtctgaaacacagcagcttgtggaacaggaaggccggatatttacatcttttacattggacatgagcaagccggaagcgataaaggattctgcagctgagctgtttgaaaacaggcagatcgacatccttgtcaataatgccggcattattcatcgggaaaaagcggaagatttttcagaagagaactggcagcacgtactgaatgtcaatctaaacagcctgtttattctgacacagcttgctggcaggcatatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggcattcaggtcaacgcaatcgccccaggctatatttctactgcgaatacaaagcctattcgggatgacgaaaagcgaaatgaggacattttaaagagaattcctgccggccgctggggccaagcggatgatatcgggggactgcagtctttttggcatcacgtgcttcagattatgtaaatggacatattttagcagttgatggcggctggctatcccgctgacaaataaaaaaagctgacgaacgatcgtcagcttttttccattacatcatgtgcggttcaacaggcaagacctttttgacctcatcaatgatgcgttcattttctccgccagcgtaaatgtgaatcgagccgctgtcttgattcgagcgaatcaggcgcccgatgccctgccgtacacgtaacaacatatatggcagatcaacttcttcgaacggatcttttttcgctccgttgcgcttcgctgtaaatacaggatcgtgtggcgggaacggcaatgaccaaatggtaacattcttcaatgcgtcaccgggaatgtcgagtccttcccataagtgaactgaacaaagtactgtttcctcttcctcttggaatttctctactaagctgctgatttcctcatcaccttcgaagaaaattggatacggcagctcccatgccgccgacagctctttaaactcgtttaattcttcaaaagaagggaaaagcaccagcgttcttcctttgtaacgtttgattgtttcaatcgtttcagccgttttttgttcagcggccatatctgtttttgcgtatagattaatactcatttgctcgtcataatcataaggggaatcaacagttaatgacaaataatcatgaatcccaagactgtcggcaatataatcaaacgaaccgccttctgacagcgtagcagaagagaagatataaggaattttcttagaaaacactttttcgccaagtacttctgctaccgttctcggcatcacgacaaaggttgattctgcttcctttttctccagccagctgatcgcatccttttgatatagagataatgaatacgccatttgttcaacatattcttccactactgacagttcgtattgatcaatcgtatacatttcagactcaaatacaagtgcctcaccgattttatcaagtaaacggcaaagctcgtccgccgcctttttgacacgctggtcattttttatttctaaacggtgtgaaccggctacttcctttgattcttcagaaagaacatagaaaaattcgtcgtttgcgagaagcgcatcttcaatcaattctgcaaactcttctctgatgtcattttgcagcaatcgttctaaaaacaattcaagagtagactgcttcactctataggttagcgctttttgcgcagcaaactctaacaaatgcccctcatcaaatacaactgcactatgatcaggcaagagcggcagctggccctctcgtttgcgtgattcttccgtccacacatgctccatataaaaatcatgggaacaaatgattaagtccgttgacttgcggtagtaatctctggaaagtgtcagaccgcatctgtgtctcatatcacaagtcagacagtcctgaaacgagtcgtagcttacgtcagaccactcttcattcgatagatttgcgtactgcttacggtcgccatacggataaaagcgctgcattgcctgtgactcgtggacaaatgacggtaacgactcataaagatccagccatttatcatcatcagaacgctgcattgttttttcaagcttcttcaagcataaatattgctcatgcgattttgacagccttgtatcaattttcagatcaagatgctcagccagcttagaaatatcgccctcttttttcaccagctgttcaattaatgtttcatctgcacaagcgatgatggcgggtttgccgacatatcttgcatagctgattgcaaaaagaagataaaccagcgttttccccgttcccactccagcttcggcgaacatgacttttttctctttaaacgcccgctccagctgaaaagccataaatacttgctcatcccgaagatcaaaccctttttcgggaaggatatcgtaaaacacgtcaccaatccaattgttcaattcttcataaaaattctttgttttcgttaaagaaaaaggcaaacgtgatgttgtcacctagttccaacccccaactattcgacattcagaccaccaataatatcattttccgctgatgaatacaataaaaaaacttggcaatgccaagttttttgcagtttacttacgattgatcacatgcgacgataaaaaaggatggtctgttgaataaatatgttctaccgctttttctaaatcagtttgcgcatgcgaaatcacagacggagacgaatcagtcccgagctccttcagctcgtttgctgttgcgtcaagcgccctttgaataagattaaaatgttcgctgttcagcatgagatcacctctgatggaaataatcatcattgtatgcgaacttttcattttatatacatgctttaccgcatgttatcaccgaaacatgcacaaactacacttgatattccgtctccggattatccgtcttatcaacaatattctatcagggagtgatgttgacatgagttatagaaaccgattagatcagcattctgaactgtttcatcacaattggacgcggcctaaacgttctaagtctcaagtaaacggtcacactgaaatgtcccaaaccaacattatattgagaagcaacgcgaaagctcaccgttggtaacgatagaatagggctgaaagatgaaagaagacgcatgcagagcgtcttctttttatgcgttttctgttttctttcgctgcggtcttacttttgaccagtattgataataatccgttttaataaacccgttaaagagttttcgtttcttcgttgcttttctgccatatgcttcctcaaagttttcatttgatgtcagcatatacacagaccaagtatcaagcggctcgaacgcctgccccatttctttgtacatctgctcaacggcttttttctcgccgagacgctctccatatggcgggttgccgacaattacgccaaattccagatttgtggtaaagtctttgacctgcatctgcttgaactggattaaatctcccaatcctgcttcctctgcattttcttttgcgatttgaaccatgcggtggtctatgtcgctagcgaaaattgtaagcggctgatcataatttgccttttcttcgacttcaagccgcgctttgttccacagatctttaccgatccattcccaatcctctgatacaaaatcgcggttgaatcccggggcgatgttttggccgattagcgccgcttctatcgcgattgttccggagccgcagaaaggatcaacaaacgggcggtcaggcgtccaattggttaattgcaccaaagcggcagcaagtgtttctttaatcggcgcaccgccctgatcgacacggtatcctcgtttgtgaaggcccgtccctgatgagtccagtgtaatcaaagcctgatctttcaataaagatatttccactttatactcagcacctgtttcttcaatccaatcattggctttgccggactgcagcttgagcttttcgacaattgcttttttgacgatccgctgacagtcgggaacgcttgcaagtgttgattttaccgattttccgatgacagggaatttcccgttttcaggtataaacgagcgccagttaatcgctttcgttttttcaaacagttcatcaaatgttttcgctttaaaagaagcaacctgaacctttatgcggtcggctgttctaagccaaaggttcgcacggcagatggcaagtgcatcaccttcaaaaataactttcccgttatcaaccttgcattcgtatcctaaatctcgtacttcctttgcgacaacagcttcaatgcccatcggcgccgttgcaattagtgtatacttcttcatcgtatcaccctgtcttttaaaacttttctcttttcaagataaaagctctccttatacgggagagcttgttttcatcattttaaatgtaagtggtctaacgttctgtaagccatgttttgttccgtcgtactgcaaacggctcatcacctcgtactcaggcggcaatcatctatctacagaaagcattctgtccttctctccgttgaattccgttaagaaggttcccctaccaaaatttgggtttctcgctcgaggggtttaccgcgttccactctcaccatttctagtgagacttcgtcactgtggcactttcaaggatactcagccatatccgaagacgtaggcttttttcctgccgtcagcctctaaagactgccctagcttatgacttcgctaggcacgaacactacgggcatctcagcaccgtgcgagcatggactttcctctacagattcaagatctgcagcgattacccgaacgttaagaacatgaattattatataacaactgattacaatttacaagcgccatttttttcaagcgtgatcaatcataaagcttgctgccaaaaacgtgtttttctaagttagacagccgttttaaaatatcaaagtttgttgtgttagattgcacaggctgttttttgctggcttcttcaagctgttttttcagctgcagattttcctgctgcagttcttcaatttcttgatggaaggtttcataatccttaataatcatatctaaaaatttgtcaacgtcttcttgcttgtagcctctaacgcctgttttaaattctttttccaaaatttctttcgcagaaagctttactttatcagcaagcatctttttcacctcgtatcgtgaatcatcacatatattttttcagaaatctgtacggttgtcaaatttctcttattgctatgagtagctgtcttcctctactgtcactctcaagtcatccattgtaataaagtagatgggatagccattctgttcgcgccttttttccgctgtcccaagcatatacttaggggagccttccttttccgggtcatataaaagcagaagcccgtcggacttatcaatgaagaactgatttttttgtttgaattgaagcgggctttcataaggacggtgagtcaggcttgcttcatagtctgcctgagccagaactgcttcatactgttccttattcggttctttccagttcttttcctgctcgtaaaatggtgtgatgacagctacctttaagtcagggtattcttcctgcaaatcatatgcggcttctgccgcccacagctctgctccaagctggcccgaaattaaaatccattctaatccttcatccaaaaaagcaatcagccggttcttaatggctttttttatgtaatacagcgccttgtcatcctgcttaaatatcccgagttcaaacggtttatagcccgttattgccaatactttcatcatttcacctgctttaaaaaatggggctcccgtgggccccatttgttgtgctgcattgtttacaccatcaagctgcacgttttccatactagtagtcgcagcaaggttttcctgcttgaaaatgctgatgcgtagccgggtcaacatttgagaaagtgtgtggaaagtagtgaacgtgctgaaaatgctggtggtttacgtttgttgtatgctgtgggtgaatgtgcggcacgatagtcttcgaaaacgtatggtgttcacagcaatgagtaggatggacaattggcgccatcatatgcggtctgcagtgatgcatgataaaatcccctttccataaactttattacaatactaagttatgaaaaataaggggtacatgttctgatgcaaagacctattttaaaagtgtgcaattaagctgtctttaaagtttgaaaacacaaaagcaatcaaaaataccacaacaaagaacaagtaaaaaacacccttatacataccaactctccctttaaaaataactaacgtcattttacaggattcgccgctattctacaacaaaatcaatgtgaattcagcaaaaaaaattcatggcgaaacaagtcgtcttttgcgctttcccggggaatattcaagaggaatatttcctctttagccgggcaattctcacatgcagtttttcagtttctttctctgataagcatgccgcatcgctaagcaattgctctgctatttgcaatgcttttccgaattcttttttcttatgctcaaaatatttcgcgagctctattacagcagcgtatctgcacttctggttttgcgagcgggacagcttttcccaaagcggcactgcttcttccaagcggttttgttttttgtacaggagcgataaatccagctgtgcactgtcctggtcctcaaacgatttttctataagcctttccaactgcttgatcgcttggtccgtttctttatgagccataaaccatttcgccatagcataggcttcactgtgttcttttggcgcatgtgattctgaaaggatttttttagacatatggatgtacaatgaaatgagcgataacacatccatttcattatgatgcaggacaccttttaaaagatccggctcttgcgcctttataaaatgaaagtaaagcattggcgccaagtagcccggtgtgtcttctagtctgcggattccgagctcctctttttcaaccgtgccaagagatacgcggtccattttgtgtttccacaggcgtctagctccatgcaaaagatcaaagtggccaaattccggaagcttcggaagtctgtcacggatcaaggtgtgtcttgttttcacctgcggccaatcaaaggctttgccgttgtaggtcacaagtgatgtaatgtcaacctcgcttaaaaagctttggtacaaggcgacttcgttccccggtttgggcaaaagatgctgtttgactgtcactcggtcttcatatactctcgcatgcccaagcaaaaaaatggtattcccagctccacccccaagaccggttgtttctgtatcaaagaaaaagaggttgtttttgttatacccttttgctgacaatgtatgcgacaggccgctttgattccacagtgtgatcacttcctcaagctcagaaaagctgtataacccatggcggtgagaaagcggatattccacttctctgataaggcagtattcatcttcgaagatgaaaggcttcataccaaaagcctcccactcttctaaaaacgggatgtcatcaaagtggttttcttgtttgcctgcttctattttttgttctccttcatcgagcaccatgtgctttttcatccgctcgagtttcccttttaatgacatatccggcctccctccttacgacatttgatccaacagctgcaaaattcttttctttgcttttatcccttctatttccgtacctatacaagacggacagccgtcatgacaaggacaatgtgtaatcagttgtttcgccgcttcattaatgtctgaaaaacgtttaaagacttcctccgccaaaccgataccgcccggataatgatcatataaaaatatggttggcaatccggtatgggctgctttaatttgagaaacaacatgaacatcatttcgatcacacatgatatacacagggacaatatgctgcagcacattcgagatgccaagaagcagctgttccagtgtcttttccccgatgtcttcatccgctgttttgattttgagccaagctgcacttgtatgcagttcttcttccggcaaatgaatgggtccagacccaatattttcaaaagtggtcatttttatttttttaaaaatggtcggcagggcattgacagtgacgtctccgtagtgcaatgacgtacggcttttttctttcgttttatcgatttctaataccttcagctgaactgccaggtttgcatccgtataatattcgacatcgacttttctgacatatgcttttttatggtcccaatcgagcttctcaacttgatactgaacgccttcatgcaaataaattgcttcatcatgtaaaagcgtcatcgcgctaaaacggtccatttcaccgataatccttacatttgcaatatccgactgatcaactataacgacattttcctgggaggcggaacgcaaactgatgtttgaagcaggaaacgactcacttgcccaatggtaccgttcgccgttgcggtgaagaacagcctcttcctgaagatactcaagaatatcactgacttccatggctccaaattcttcatcagctctaaaaggaagctcataagccgcacactttaagtggtctactaaaataatcaaattctccggattgattcttgcagattccggcgaacgattaaagaaatattcaggatgccgcacaatatattggtcaatcggtgttgaattggctaccatgataatcaaagattcaccgtgtcttctgccagctcgtcccgcctgctgccaagcacttgcaacacttccgggataccccgtcattacacacacttgcagctggccgatatcaacaccaagctctaaggcattcgtactgaccactcctaaaatgtcgccttctctcagtcctctttcgatttctcttcgctctttcggcagatagcctccccgatagcctctgattgattttgttccaatctcttttttcacaagctcctgaatatggcttaaaataatttccacccgaactctgcttctggcaaaaacaatggtctgcactttgtttttaaggaactctttcgccagttcattcacttctgcggttgcgctccttctaatattcagcggtttgttcacaattggcggattgtaaaacacaaaatgcttgcgtccgctcggtgcgccgttgtcatcgaccagccacatcggtttgcctgtcagctgctctcccaattcctttgggttggcaattgttgcggaagtacaaataaaaaccggatcacttccataaaaccggcagatccgcttcagccgccggatcacatttgccacatggctgccgaacacacctcgatacgtatgaagctcatcgatgacgatatacttaaggttttcaaacaaactgacccatttcgtatgatgcggtagaatggcagaatgcagcatatcggggtttgtaatgacaatatgacctgcttttctcaccttttgtctgattgccggagacgtatccccgtcatatgtaaagcttttaatatcaatgcccatttcatcaataatttcatttagctcgctcttttggtcttgtgccagcgctttagtcggaaataaatataacgcccggtttgtttcatcttgggcgatggactgcaggactgggaggttgtagcataacgtttttcctgatgctgttggcgttacggtaacgatgctttctcctttttgcacatattgaaaagcggaatattggtgagtatatagttcatcaatgccccttttcgaaagggccgctttgattctctcgtctatactttcgggcataggccttgtttttgcttcccgaggctcaatttcatgccaattcacaacgttttcatttccttttaaatcagaaatgagttcagtcagtgatttctttttcattctttacacctctttgtcaagtacagtttaccgaatatttgtttgcatggctaggtgcaaattttatacagttgaataaaaaaagcaaggcatacgccctgcttatttcgcttttattgtaaggagctttgattcgcctttacgagcagccttttcgcctgccggcacaattgaccctacagcctcaccattcattataacgattgggatgactgtgctgctcgctttttcttttattaattccaaatcacatgtaatcagcgggtcaccgaccttcactttatccccttctttaatgtgggcagtaaatccttctccgttcatattgactgtctccagcccgacatgaattaacagctcaattcccgagcgagtccgaatgccaacggcgtgtttggtgtggaaaatctgaatgacttcaccttcagcgggagaaacgatttcaccgctagaaggttccaccgctattccttctcccatcattttctgtgaaaaaacagggtccggtacatctgacaggtccattactgtaccgtctgccggagaataaataacctcttctgtcaccttttcctgagttttgcccattccgaataattttttcagcaatgtattttctcccttctcattcacttcaaccgttatcccttcattcaccactatttaaccacactttcaattttgcttcaatttataacaacatctggcatagacgcataatctggttaaaaaaggcggtggcgaaattggaattccatgatgacaaaaagaacgaactgcaaaagaaagaagaaatcataacggaggcaatcgacactcttttccaatcctcagcgttcggcaaccttataaacggatttcagaacctgatcaactcgagtttaaaggatgtgcagacgaccatacatgtcagagaaaaagatactgggctgtatatcgatattaccattccggcgacgtttcgagatggcgagatcgtcgttgatgttaaatcgaggtatctccatgtaacactccaagaaaaacagaaacaccaaaatgaggctacctttacaagcatgacaagaacggttcagctgccttatgaagttcgccaagaagatatggaaacgtcttggaacgagcagacaatgacacttttctttccaaaaaataagcatgaatgaacgattcattcatgcttctatcatttaaaaaagctggtaaatccctttattaaagatccgacctgattcattgcactcattacttgacctgtcgtatccatcattttattaaaatcaaattgcccattggcttttttgaactgcgacataatgctttgaaattgcgaaggctgctgttgattaggccttgggataggataagggttagaaaatacaggcggctgcataggcataggctggatcggagcatagggctgataataatcctgctgtccataatgctgctgaggcagttgttgctctaaataaccgggtgcagcctgctgataatatccttgcatttgctgaggataataatagcccatttgccgaggatagcttcgagagctcctgttcattgcgattcccccctaaacacaacatatttctcttctatatatgtatgaatgacttctattgtttgtgtcacaagtgatgattagcatttgtcaaattgtgtcgaaagtttaaattttttaaaaacagaaaaaagtcgaatcattatggtaccatattttcaatacagatgagaggggatgcaccataatgaacgtatcatacttaagcaaacgttttgcagaaatgaagaaatatgaaacagactgtatgaataaactgatggactttgccaagttcctctatattcaaggacatctcagcataactgagtttcgtaacagtatgaaggttctcgaagcaaatggagcagaaagcccggcatatgagatgaattaacgtccggccccctataaaaacgaaaagaagacagccttttaccggctgtcttctcttgcaatttcatcctttactgcgtgcaatgtataaaggactgactcagtgatgtccttgaatcgttttttatgaatatgatgaacatatgattgaaggaccaattccaggaaattatcttttacggtctcaatttgctctttatgcacatattttggccggtgggcttttatcaattcaagagcaccctctgcccagcgggccgccagttcatcattctcttcaactgcaggctttatcgtctcaaaaaaatcataagaatgattactgttttttccttcctgataccgatcagcgcctttttcagcaacttcaatcatttgctcggtcatttccagcaatgtttgtgatagcaatacctttcacctcaatgcttatcgtaccaaatttcactcacaaattcagccgatgcggtataccttctcaaacgcatacctgtgttcaggcgattgatacagctcatttatacaaatatgaagatctatgatttcttcttcaagcacacttaggcgatcgttttccgtttcccgcatctcagcctctaatgcatttacagaatgattcaggctttgctcagctcgcgttaattcatcttctatatcagaaagcatacggagaatatctgtcttgcatacataaccggacattcgtgtacctccctttccttgtctctcccggttaaaattctttgctctcaaggctctttccttcctcatgacaaaactagaagcaaatcgccaaacaaacaggtattccacgaaaagctgaagttttcgacaaaaacacccgcaaaaattgtatgatcctcctccttaatgcaaacgatacttgtgaggaggtgccgtatgaaaacaagaccgaaaaaagccggccagcaaaaaaagactgaatcaaaggcaatcgattctttagataaaaaattaggcggcccgaaccgcccttctacgtaagaagcaaggaatttccttgcttctttatttttttagccactgctccaccgcaaaaagcgcatgaagctggcgctttttatgtaaataccagtctgtcaattcaatctgcttcggcaattcctcgcgcctaaagaacgttttctttatctttccatgaaaccaatctgttttcgttccgtctaatgagtggattaactcagggtagcatgtccttagcataggagatgttctttttgtaatcccgatcatcttttccatatcaaaacgggaacctgtgtgcggcactgtgtgcaaaaagtgataaaaagaggagaacaattctggcttgaacagcaattgagacagctgctttcccagccttatcctttcctccgcctttgaaaagcgtttcactgaaatgccgtaaagaaacccatttgaggaaggaaaaataacggtgttaaaatgaaaccagtcacttaaataaaaaggaatcgtgtcaaaaacattctttttaaacgaaggattttgtataataggtgtttggatagtgttttgttcatttataatgagggcatacattagccgctccgtatttcgctcatgccaaaaacgggtccattcttccgacataaattgtgagacgccaaacacatgcagaagatgaaacagcggtttcccgactctttttgaccagtggtatagtagaagctgcggataggcatccgaaaaaataagccagttcgctctttcataggctaaaaagaaccatttttgctgtctctcacggagtccaagctgaaacagactgccttttaagtcagtcattgaccagccggcattacgagaaacgaaagaagccaaaagcgaccatttgatttccggatgacggtcgtaaaatgctttataagcatttgttcttgaaatgttatccgcgtttttcatttttgtctgccgctcaatccggctcagaagctttctgatggtctgttgttcttgcacgttcattcacttccgtcatgattagtttaataaggaggatgagaaagtgattcggtatcctaacggaaaaacatttcagccgaaacattcggtttcatcccaaaacagtcagaaaagggccccgtcttacagtaatcgcggaatgaccctcgaagatgacttaaacgaaacgaataagtattatttgacaaaccaaattgccgttatacacaaaaagccgacacctgttcaaattgtaaatgtccattatccaaaaagaagtgccgcagtgattaaagaagcttactttaaacaatcatcgacaacagactacaatgggatttacaaaggacggtatattgattttgaggcgaaagaaacgaaaaacaagacctctttcccctgcagaattttcatgaccatcaaatcgagcatatgaagcaggtaaaggctcaagacggtatttgttttgttattatatccgctttcgaccaggtttattttttggaagccgataagctgttttatttctgggacagaaaagaaaaaaacggcagaaaatcaattcgaaaagatgagttggaagaaacagcttatccgatttctcttggatacgcacccagaattgattatattagtattattgaacagctttatttttcgccatcatctggtgcgaaaggttgattaacgaaaggttgagatgttatgtcagatcaatttaacagccgtgaagctcgacgaaaagcgaacagcaagtcgagtccttcaccgaaaaaaggcaagaaacgaaaaaagggcggattgtttaaaaagacccttttcactttactcattctgtttgttttaggcgtagtcggcggtgctgttacatttgccgtcatggtttctgatgcgccgtcccttgatgaaagcaaattgaagacgccttattcatcaacgatttacgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgctttagttgccaactttaaagatggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttacagatttaagcaaattgactgtcgaacaggctgccacactggcaggcatgccgcagagcccaacagcgtataacccggttaaaaatccggataaagcggaaaaaagacggaacatcgtcctcagtctgatgaaaaaacaaggatttatttctgattctcaatacaacaaagcgaaaaaagtggcagtgaaagacgaaggcgtcgtgtcacagaaagaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcgggtttactgaaggcatgcagggcggcgttacccttctcgatacgaaaaccggagaagtgcgggcgattggcgccggaagagattctacggttggtggctataattacgcgacccaagcccagcgacagcctggatctaccattaaacctattctcgactacggtccagtgattgaaaataaaaaatggtcaacttacgagcaaattgatgactcagcttacacttattcagatggaacacctattcgagactttgaccgttcctataaaggggtcatgtctatgcgtgaagccctcgcccaatcacgtaacatcccggctctaaaagcattccaagcagtcggaaaagatgcagcagttgattttgctaatggactggggctcggattaaataaagaaaaagtgtatgaatcatattctatcggaggattcggagaaggtaatcccggtgtctctactctaactatggctggagcatacagtgcattcggaaataacggaacatataacgaaccgcattttgtgaaatcaatagaatttaatgacggcacgaagcttgacttaacaccgaaatcaaaatcagcaatgagcgattatacagccttcatgattacagatatgctgaaaacagctgttaagacaggtactggacagctcgcccaagttccgggagtggaagttgcaggtaaaacaggtacaacaaactttgatgaagcggatatgcaaaaatacaatatcgcacaaggcggtgtaccagattcatggtttgtaggatatacacctcaatataccgctgctgtttggacaggtgtagattctcaaaataagataggaaaaaaatctttaaataaaacagagcaacagattgccaagcgcatcttcgcccagctcattgccgatgtcgatgacggaagcggatcatttgagaagcctgacagcgtagtggaagccaccgtagaaaaaggttctaatccggcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattatgacggagatgcgacctttgctgttaagcaatctgttgacggcggcagctactcggaaattcaaaacagctctgcaaaagaggcagtcatttcgggtgtgcagccaggatctgtgtacaaattcgaggtaacagccgtcagtgatgatggcaaaagtacagcttccacatcttatgaggtgccaaaagctgaagacgatgaagataaaaaagaccagcaacaaacggatgatgaaaaacaagatgatgagaagactcaggatgatacacaaactgatgattctcaaaaagatgacggtaagacggatcaagatcagacagatgattcaacaaatgatcaagacaaaaatcaagacaacacgaacaccaatccgtctgacaacagtaaccaagaccaatctaacaatagtaataacaataacagtaataaccaggatacgtcggatggtgattcgaactcagatacgaatgactcaacaggtactgacacgaataaaaataaaacagacacatctaataaaacacaaacaaactcatcatcaattgaaaaaacaaattaaccaaaaaagccgtcacctttggggtgatggcttttttggtacacaataaaaaacctcccgttttaacaggaggttttatcgattcatcgcatgatatttataaaaatgctttttcatttcggtaatcagctcatcaagctgaataaagcaatggtattgggtcggcttaagaagaataaattccactcgttcagcccaattaatcggctttgcgggatatgatttctccctcagttcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcctcccatggcaaatcgccttgtaattccgtgcagaaatcaaaatacacgggattggtctgcaaggttttcttcatatccgaggaactcttctggccaagactgcgcaagtattgctcataggaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggcaatggccggcacgccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagctacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcttgctccacagttttaagcccgtttttcttccattcaaacaaaatccggtcaatgtagcggaaactgagttttcctgatagtacagcctcttttaacgcgtgtttgatcagttgtgcgtcatgctgatcctggtcctgccagatcgccagcgtttcacactccaaaggcgataacggccttgcgaactcttcctcaaaaatggtataaaggcttttttgttcccttctgcttttctttcctgtgtttgattctgtgcaagctgaatatactcgtacagcttgccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtaagcagaagattggggatggttgatgttccctgctcctgcatatcaataaattgctgttttttcatcgtcacacctcttactgtaaaggattgtgattgcccctttactgtaaaaagtctcccttgcaggagactcttttttgtttcatttgaatgtattacggatacagacggtttaacagtcttgggaacggaatcgtttcacgaacgtgaggcgctccgctgatccaagctactgtccgctctaatccaaggccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtaattcttgggaacggagctttgatttgctcaagttttgacgtgtctcttcccaatgtgtttagttcaattttgcaatttttaagaactgattgcacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatatgcatcttcatcaaagtactttgtggcaaagagttctgttgttccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttctgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagtactttaacaaattcatctacatctttgaaaccgcaagattgagctgcctctattgcattcgggaacaagtaaaaagcaccttccggcttcacacagctgaaccctgggatttctatgagctttgcatagatcgtgtttaatctatgttcaaatgcttctctcatttcttccaatggctcagaaggcccgttataagcagcaatcgctccgtactgtgcgattgatgtcgggtttgacgtactgtggcttgcaaggttcgtcatcgctttaataatgtcttcagagcctgccgcataaccgattctccagcctgtcatgctgtgggacttcgatacgccgtttataatgaccgtttgttctttcagtctgtctgacagctgtgcaatggaaacatgtttctttccgccgtatgtaagtttttcataaatttcatctgacacaatcaagatatcatgttcaaggcacacttcaccgagtgcagatagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccggatagcttacccagtaaggcgttggaataataacttcatcttcttcatccaaaatcacttggaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggttctcctgctcctaagccgatgacatcatggcctgcggctttcagttctttcgctttcgctgtgattgccagtgtggttgatggtgttaatgcggatactctttttgccagtttcaacttgaactcccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataatgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagcgcaaggccgaacatcagattgtctcttttcagtgtacgattcaatgtgtccacaattttatacagatcatcagaatgctctacattaattgttgaaagaatttcgattttactttccattttttcatcctccagtttgaacaaatattgttagtcatactccatttcaggacacgccatactagtatcacagagcgggaaatccgcttttaaataaaacaccatcctactcccacaccgcaaaagccgctttatgcggcttttattctttttcccctgcaacataagcttcaagctcgctgtcagtcatttcggatactgaggttgtcggcaaggcatcaagaaacagccggccgtaaccagcggttttaatccgtctgtccaatatcataatcgttcccttgtctcccgcagaacgcagcaagcgtccgattccttgcctgaaggtcagcacagcttccggtaatgacactgtttgaaacggattctttccttttttgcgggcaagctcacattttgcagcatgaagcgggtgatcaggggaccggaatgggagcctcacgatcattactgtcgtcagctcatcaccagggaaatcaacgccttcccaaaaatgatttgttccgagcaggatcgcctgattggatgttttaaaagtcttcatgagtttgccgggacttccgcctgtaatcccttgtgccaagagctgaatgccggaagcactcatgttatgcttaagctcctggtgaacctttttcagcatatcatgggatgtaaacagcacaaggattttaggctgtttttcctttgccatcagttcgatataacgggctgtatcctgtataaattcaggttgccctgtatcctgaattgatttcatttcctttggaatcatcacctgcatacgctcatcgtaagaaaagggtgactcaattctcattgtccgcgggaaaaagtcactcagtcccagtcgttcaatcataaattgaaaagaaccttcgactgtaagagttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcgtcatcagacccaaagaagagcttctgcaacgtctgacagtaatgctgcaagcctttcatgcttctttggtattcatcggctaaaaagacggttttgctcttcatacccttcaaatgtttttccatcagggatgactgcgcctcaaaaagctgctgcaaatgtgtcagcatggaacaaagcctctccgcaccatccgttaagatcgaccagcttttatcctggctttctttgttcaccttaaacactagacggtttaagtcttctttaggttttcttcgtttgacaaaagaatgtacagagctaaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtagctcttttccctaaatgttcgcttgccgcacgttcaaaatggtgtgcttcatcaataataaatgtgccgctttcgggaagcctttttttctggctggcttcatcggtcagcaaaagggaatgattggtgatcaccaaatcggagcgcatagcaatctgtttggctcgctcgtaaaacccgatcacatgctcactgcgacttcttttataggagtcatcgtcataagccaatctgtcccacagcaattttccgcctgaaggcaaattcagttccgctacatctcctgtatttgtctctgtcagccaaacgagaagctgtgcctttgtcagtacagcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaatgcatcagccacctctctcatcatcatcatttggccgtctcttttttcatacccaggcattaactctgacagcgctttttcatttcccgcttcccagctttcgatctcaaatgagaagttctcgtcctcatttatacgagcatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatgcgtgagagctcgacagtatcaagcacttcacaatctgggagctgaaagcccgccttatgtagctcatacttgacaaatccaaggtcaaaatggatattgtgagcgacaaaataagcgccgtcaagcaattggaatacttcttcagcaactgcttcaaatggctgttcattttctaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaaccccgataaagggggcttttcttctacaaaattgtacgggctggttcgtttcccagcatttgttcaattttgttttgatcattcagaacagccactttcggctcgtggcttgccgcttcttgatcagacatcattttgtaggaaataataatgaccttatctccttcctgcacaaggcgtgcggctgcaccgtttaagcatatgacaccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagcttgccgctcatcattgttcgatacatattatattctctccatttctcgaatatcaataatgatattatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagttccgcacttgtttgaagggcccgatacagcttaggcgcttcttttctttcctcagctgttaagtatacattgcgagagcttttggctaagccgtcttcctctctgaccgtatcgacaggaaccaatttaatatccatgaagaagtcactgattaacccatcaacaacagctacctgctgcgcatcttttaaaccgaaataggcacgagtcggcttgactagattgaaaagcttcgtcagtacgatcgcgaccccgtcaaaatgtccttctcttgagcgcccgcataacacgtctgtgcgtctttctacatgaatcgtgacattcttttcaccgggatacatatcatgagcatctggcgtaaataaaatatcgactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatggtattgttttatggcttctttcagctgtgaaatatcagtaatctgtctcatcttattttcccccgtacaagccgtcaagcactgtctggttcatttgaaaggaatgcttttgttcagggaaagcacgatgtcttacatcctgaacatatccgctgattgctgtttcgatggtttcatcaatgcgcatatattgctttacaaatttaggtgttctctcaacaccgtggccgataatatcatgataaacgagaacttgtccgtccgctttcacaccagccccgattccaatgaccggtatgcttagcgtctcggcaattttggctgtgagttctgccggcacacattccagcacaagcatcatagctcctgcttcttcgcattttatactgtcttctattaatttttttgcgctttgttcgtctttgccctgtactttatagccgcccagtacgccgactgactgcggtgtcaaacctaagtgactgactactggaatgcctccaagcgtcaatgcgcgaatggattcaaacacgccttctccgccctcaagcttcagtgcgtcagctccgctttcctgaacgatagccgctgcatttttcagcgtatcttccttagacaggtgataagacataaacggcatatctgtcacaataaaggtattcggcgcaccccttttaacggcttttgtatgatggatcatgtccgcaactgtcacaccgacagttgaatcaaggccgaggacgaccattccaagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgttttcttctgcaagccaaaaaaccttccgttacaacgagaaggattcttcactttctaaagttcggcgagtttcatccctctgtcccagtccttttttggatcaaggcagactgctgcaatgtctatctattttaataataggtgcagttcgcaggcgatactgcccaatggaagtataccaaaatcaacgggcttgtaccaacacattagcccaattcgatatcggcagaatagatttttttaatgccttcgttcgtttctaaaagcagaacgccttcatcatctatacctaacgccttaccgtaaaaggttccgtttaacgttctggctctcatattagtgccaataccgagcgcatagctttcccataaaagcttaatcggcgtaaatccgtgcgtcatataatcccggtaccgtttctcaaagcatagtaaaatatgctgaatgacgccggcccgatcaattttttccccagcagcttggctgaggcttgtcgcgatgtccttcaattcatctggaaaatcattaggctgctggttaacgttaatgccgatcccaatgatcactgaacgtacgcggtcttcttcagcctgcatttccgttaggataccgactgttttttttccgttaatcaaaatatcatttggccatttaatatccgtttggatgcctgctgcctcttctattccctgcacaacagctactgcagcaagcagagtcagctgcggtgttttttggagcggaatgtcaggccgcaaaatcaggctcatccaaacgccgtttccttcttgagaatgccaaaccctagacattcggccccttccggctgtttgtttgtcagccaccacgagggtgccttccggtgcgttattattcgcgagctcatgagccgttttttgcgtgcttgaaagaacgtcatagtaaataagatgctggcccatcacttccgtttttaatccaaaacgaatttcgctttcactgagttttccaggctttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaataaggtcttttcttaatgttgaccgcatgtcttcagccactcctctatgtgtttcttttgattggagagcttccctgtcacaacagcctgctcgatccgctgtaattcttccgacacccattttccagccggtcggtttcgaagcgcaagcaagtccttacccgtgatatcaagatccttaaggcttttgatcggcaggttttgataagcgtactgaatgtccttcagtttcttttcatccagtttttcgttttgccgaagctgcgatattttggccgcagagagcagtgctttttccccagctctgtacattgtcattacgtcaaggctctggccaaacgtatcagcaatgtgaatggcttccttgatcgcttttcccgggagcttccaggctttcaggaaaaggggcgcgtctttcaagactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagcgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaaacgtacggctctcagcatacgaagcgcatcctcttgaaatctatcctcaggctttccaacggttcgaatcactttctgatcaatatctttcttgccgccaaaataatcaagcaccttcccgtccgctgtcatggccatcgcattgatcgttaaatctcttcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagttcgctgaaacagccgttctacttgatcaggtgccgcatctgttgcgatatcgacatctccgatcgttcgtttcatatagctgtcacgaactgcgcccccgacaaaataagcctgatggcccgcttcgattaagatgcggagcacgggaagtgctttgataaaaactttttccatgtgatcactccggttctgctaaatctgcataaatctgttcatactggctgacaattttttgggaagaaaattcattttcaagcatctctattgccgcctttgtaaaacgattgcttagctgttcatcttctaaaatgctcatcgcgcgggctgttgcggccgcaacatcaccgacatccaccaaaaatccgctcacattgtttttaataacctcagggataccgccaatgtttgttccgatacaaggcactccgcaagccatcgcttcaagcaggacaagaccgaagctttctttttcagatagcagcagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacctttctaaagttggacacatggatgacgactttttcatctggtaaaattccatgtttctctttaatcaccgctgtgtttttcttcagatacacgcgctcgtctataaagttataaatcgtttcaatttttttctccggtttaattaaatcgtacgtttcagccgcaagcgctgaggagactgcagtcaccctgtctgatgactcaatagcaaaacggatcagatcttttagagacggatcataacctaacaccgtgatatccgtgccatgcaaagttgtaacaatgccgatattgcgtttcagcatttgttttgcaagataggcgcatacggcatgcggaagagcatagtgagcatggataatgtctaaattctcccgttccgccacctctgcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacccgagcctccaacgctcggatagcatgtgattcctatttttagttttctcattgttcgcccccaagcacatcatgatcaagcatcagcatccgtttggaaaagaaaccttcggcatactccacgcccgcttctttaccgtaaagcttttctctcgcttcaacgatctcgatataaccattcgtcagaggagtagaaactgaatcctttgacgggataaactggcttttgtaggcgttgaggctttgttcctttgcctctattgtatccgagatatcaatgacaaaatccggctgatgaaaaccatttatcatataatagtaaaccttgctgactttatgcgccggaaggcttttttcatctttatatttatggattccggcggaaaagatcgcttcttccaccagtgcagccgcattgccgtgatccggatggcgatcctttttatacggcataaaaaccgcttttgggcggcaggttctgatgacagtgacaatcgaccggattgcctgatcactcattattaggccgcggtctggaagcgtcagctgaattcttttatctgcgcctaatatgcgggctgcttcagctgcttcttctttacgtaaactgaccgtaccgttagaagagagttccgcttctgtcaagtcgcatatcattactttttttccctgtttgacaaacttcgctattgtgccgcccattccgatctcgacatcatcactgtgggcgccaaaagcaagaacgtcagcattatacattcggctcttctcctcgaagaaggtcacggaattcgaaaacaccttcatcaagtgtgcggacgagaatttccgcagtacccatatttgtggcgagcggaatggaatacacatcacataaccggattaatgccgagacatccggttcatgcggctgcgcggtcagcgggtcgcgcaaaaaaatgacaagatcgagtgcattggcagcgatcaatgcaccgatttgctggtctccccctaaagggccggattgaaaacgttcaatttgaagacctgtcgcctcttgaattttcaaccctgtggttccggttgcgtataaatcatgattctttaaaatatcccgataggcagtcgtaaattgaaccatgtcctgttttttcttgtcatgcgcgatcaaagcaattttcattgtttatcccccgtctaatcaatgatattttctaaaccgtacacaagctgatcaatcttcatgacttgttcgactgacagtttaacgcctgacatgaaagaagcacggttataagaatcatggcgtatctgaagcgtttggccatccatgccgaacatgacctcctgatgcgcgatcagtcccggaagacggacgctgtgcaagcgaatgccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagacgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaagcaggcatggatatctgtgtaaattaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatcttgatctcctctactttccttcttcttttctggtccagcgatctttatctcttgtattaaatttatgcatgactcggtcgtgagcttcctctaaagagatatcaagagagttggctaaacaaaccaatacaaatagcacatcgcccatttcctcttccatgcttttatcatcttcagtcgctttttttggtttttctccataacggtgattcacttctctggcaagctcgcccagttcttcagtcagcctcgccatcatggccagcgggctaaaatatccttctttaaattggccgatgtaacggtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggttttgtgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatctcgaacctggtgttgaacattccgattttttttattggctggcgtttgctcggcaggacaatgtttgtttatacccttgtcggcactgtagccttgtctttgttcctcagcatctttcagcgatatgaaatacatatgccccttcagcacgacttagcgctcgccgctttatttgccggcgtattcatcggagccggactgggtattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcctcgaaaaacgacctgattcagaaaaagattcttgaagaaatggaacgtggcgtcactattttgaaaggacaaggttcctacacaaaagaggatatagatgtactttattgtgtggtgccgaaaaacgaattggtgatgctaaaaagcgtgattaactccattgatgcccatgcctttgtagcggtaagcgatgttcacgatgtgctcggagaaggatttacgcttgatgaaaataaaaatccgcttccgcgctgacatgtaatagaaaaaaggcggctgaccgccgcccctcatccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcttgctgaagaagggaaagccgttcaagcttcgtgctctctgtcatttgctgaaactcctcttgctcaataacatctatatgttttccgactgtttcaagctgatcctctgatacatcgattgtaagactggggtaaatcaagtcatataaactgataaattcattccatttttcatgaaagcttgtgcttccattcttttggacatctcgcttcagctcagtaaaagcttccataattggtttttccagtgaaccccaaagcgggtcagaccgattgtcaaccgcatccatcagcattctgaactgcgcggctgctctgagtttttgtgtgtctgatgtatcagcttgctttaaactccgaaccatatcattatagcccaatgtgatttgacggatttgggctcccgttagcatggggtcttgctgttttttctcagcggattttaatgttttttcaaaatactccaagacttgaagcgcctcttcatatttcgcctgtcgggtcatttgaaagactgtatcggataaatcattcaattcctcgaggcttccccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgctttttcgagaccacaagaaagtaagcaagcccgattgaaaagatgcttagccaaaatgttccgtatcctatttcagtcatataatcagaaagcatagagtattgcggcatcatatcaaacaagtagtcaatgacatcgttatgcagtgtccagactgcagcaattgcaagatgccaaaatgaaaaacgaaaatacggactgtataatacgccttgaactgccattgcaaaatgcgaagcaattagcatgtagccctcccacggcaagtcaccagttactgcaagcacaagaaaattcatagccaccgcccataggccatactttacgagggtaactagcgcaagcgcctcaaagagcggagcattccgtttcatgagaaaggcaagcagcacaaacagaaagaaaaacgttgctgtcggactgtccggaacaaaaatcaggaaacgggccggtgtctccaaaagctgcggcaagtaccaatagtagccgtaaaccgttcccagaaaattaatggctaagacaagaataagtatcggccgctgccctaatacatattgaaaccatttcacatcgaatcaactctcagtctgtaaaaataatatgtccatataaaaaagctgacgccgggtcagcttttgataataaaagtatatccttccatttgacaattcacaatacgttattttgcggttgtttcagaaataaattttgcaagttcttcgagctgcttatcatttcctttgaacacacccgccggcattttgccttttccttctacagcgatttttttgatttcttccggtttcagcccgctgtcaaccaatgaaggcccagccgctcctccctgaaggttatccccatggcaagaaatacagccctgttccttaaagaccttatatccttctgcattggtgtcaatgtcggcttcttttgtgattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccagcggcgtattcatacttcaacagctggtataagaaaagaaaataccaatccggcagcggaatataaccagtatcagtcgggtccgccatccgctccaaaggcggctgatgcacaatcgtcaaaacgagaaaaccgatgagaaagacagctccaaccatccattcctttaacaagaaatttggccagaaagcctctgttttaccggatactccgaataatccttcggtatattcggctttttttcagccggtatccttgagtcgcctacaaatttcatccctttgccccggtgcatgtcatcccctcccttttattcgcagatcaagagtttaaagcggtcctgaaattccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacctgcgttccgatcaaaggcgtggcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcgccttggaaaaagaccctcagcgtatgtaaaaacatcatcacaatgaccaggctcgcaccccagtggtgcatccccctgacaatctggccgaatgctacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacgcctgtgagcgtgtaattcaaaaattgacgtctggatatatcatgttttccgcccatctcttctccccctctaggtacccctgcaaactaactaaaatagaaaatattgcaataactctagacaccctcataatatatgaatctctcagcaaggtcaatatagccaaaatattgtttataaggaatgtaagtgtttttatgaagtgctccataactgtaacaaaacgttcaaaatttcagcagtgcgttcatccaatatttttctttttaaagagtcatttaaatgctctaatggaacagacggtgtaacaatgattttgcctaacgcatcctcagctctccaactttcgtcagatgtgagcaggacaacatgcggaaattccgttatcagctcttccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggcatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcgtcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagcgaacggaaattaagctggataaacaaatctgctgtttatttaatctaatatcatgaaaagatttttccgcgtcggtagtcatgacattctctttatagaaccggaacggaacttcttcaacacatgtgttgacattataatgcctctcgg

SEQ ID NO: 7 - DNA, 1476 bp, Bacillus subtilis
gctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttagagccagccgccgaagtgggacagatgattggggtg
